United States Patent
Collingwood et al.

(10) Patent No.: US 12,152,258 B2
(45) Date of Patent: Nov. 26, 2024

(54) OPTIMIZED PROTEIN FUSIONS AND LINKERS

(71) Applicant: Integrated DNA Technologies, Inc., Coralville, IA (US)

(72) Inventors: Michael Allen Collingwood, North Liberty, IA (US); Steve Ehren Glenn, Iowa City, IA (US); Christopher Anthony Vakulskas, North Liberty, IA (US)

(73) Assignee: INTEGRATED DNA TECHNOLOGIES, INC., Coralville, IA (US)

( * ) Notice: Subject to any disclaimer, the term of this patent is extended or adjusted under 35 U.S.C. 154(b) by 150 days.

(21) Appl. No.: 17/235,921

(22) Filed: Apr. 20, 2021

(65) Prior Publication Data

US 2023/0049003 A1    Feb. 16, 2023

Related U.S. Application Data

(60) Provisional application No. 63/012,658, filed on Apr. 20, 2020.

(51) Int. Cl.
*C12N 9/22* (2006.01)
*C07K 14/47* (2006.01)

(52) U.S. Cl.
CPC .............. *C12N 9/22* (2013.01); *C07K 14/47* (2013.01); *C07K 2317/24* (2013.01)

(58) Field of Classification Search
CPC .......... C12N 9/22; C12N 15/62; C12N 15/90; C12N 15/70; C12N 2310/10; C07K 14/47; C07K 2317/24; C07K 2319/60
See application file for complete search history.

(56) References Cited

U.S. PATENT DOCUMENTS

| | | | |
|---|---|---|---|
| 2016/0376610 A1 | 12/2016 | Davis et al. | |
| 2018/0112255 A1 | 4/2018 | Chen et al. | |
| 2018/0312828 A1* | 11/2018 | Liu | ......... C12N 15/62 |
| 2019/0032131 A1 | 10/2019 | Turk et al. | |

FOREIGN PATENT DOCUMENTS

WO    2019/210005 A1    10/2019

OTHER PUBLICATIONS

Witkowski et al., Biochemistry 38:11643-11650, 1999.*
Tang et al., Phil Trans R Soc B 368:20120318, 1-10, 2013.*
Seffernick et al., J. Bacteriol. 183(8):2405-2410, 2001.*
Singh et al., Current Protein and Peptide Science 19(1):5-15, 2018.*
Sadowski et al., Current Opinion in Structural Biology 19:357-362, 2009.*
Liu et al., Cell Discovery 1, 15007, pp. 1-11, published online May 12, 2015.*
International Search Report and Written Opinion for International Application No. PCT/US2021/028260 dated Sep. 17, 2021, 10 pages.
Vakulskas et al. "A high-fedelity Cas9 mutant delivered as a ribonucleoprotein complex enables efficient gene editing in human hematopoietic stem and progenitor cells," Nature Medicine, vol. 24, No. 8, 2018, 34 pages.

* cited by examiner

*Primary Examiner* — Delia M Ramirez
(74) *Attorney, Agent, or Firm* — Klintworth & Rozenblat IP LLP

(57) ABSTRACT

This invention pertains to optimized protein fusion linkers for creating multi-functional chimeric proteins and methods of using the same. Additionally, the invention pertains to chimeric proteins for use in guided endonuclease systems.

2 Claims, 12 Drawing Sheets
Specification includes a Sequence Listing.

OPTIMIZED PROTEIN FUSIONS AND LINKERS

CROSS-REFERENCE TO RELATED APPLICATIONS

This application claims benefit of priority under 35 U.S.C. 119 to U.S. Provisional Patent Application Ser. No. 63/012,658, filed Apr. 20, 2020 and entitled "OPTIMIZED PROTEIN FUSIONS AND LINKERS," the contents of which are herein incorporated by reference in its entirety.

FIELD OF THE INVENTION

This invention pertains to the chimeric proteins and methods for their use in living cells.

SEQUENCE LISTING

The instant application contains a Sequence Listing that has been submitted in ASCII format via EFS-Web and is hereby incorporated by reference in its entirety. The ASCII copy, created on Aug. 25, 2021, is named IDT0-019-US_ST25.txt, and is 4,468,332 bytes in size.

FIELD OF THE INVENTION

This invention pertains to optimized protein fusion linkers for creating multi-functional chimeric proteins and methods of using the same. Additionally, the invention pertains to chimeric proteins for use in guided endonuclease systems.

BACKGROUND OF THE INVENTION

The fusion of guided endonucleases to one or more unrelated enzymes is desirable for many reasons. In some cases, it is useful to visualize and monitor successful delivery of guided endonuclease reagents into the target cell nucleus or nucleolus. In other cases, it may be useful to fuse DNA modifying enzymes to affect a specific repair outcome after guided endonuclease cleavage.

The construction of recombinant fusion protein requires the selection of a suitable linker to join the protein domains. Direct fusion of functional domains without a linker may lead to many problems, including misfolding of the fusion protein, low yield in protein production, or impaired bioactivity. For example, a barrier to using engineered nucleases fused to a fluorescent protein is that such fusions tend to have lower editing activity presumably due to steric interference caused by the unnatural fusion of the two proteins.

Achieving high functional activity for the fusion proteins can be dependent on the nature of the linker between the subunits as direct fusion of proteins can inhibit folding, stability and biological activity. Additionally, linked domains can interfere with each other's functions and physically separating these domains can lead to improved function. The nature of the linker between domains can influence average separation distances depending on linker rigidity and length.

Linkers are typically placed in three classifications: flexible, rigid, and cleavable. Flexible linkers usually consist of glycine repeats, with the periodic addition of a polar serine residue to disrupt linker-protein interaction. Rigid linkers include $A(EAAAK)_nA$ repeats that form an alpha helical structure or a Pro-rich sequence, $(XP)_n$ that form relatively rigid extended rod like structures.

As such, what are needed are methods and compositions to overcome the existing challenges of current technologies. New methods and compositions for a set of universal peptide linkers that have been specifically optimized in guided endonucleases enzyme fusions is desirable to improve function of the guided endonuclease as well as the covalently fused protein partner.

BRIEF SUMMARY OF THE INVENTION

In general, this invention pertains to methods and compositions for improved multi-functional chimeric proteins and improved linkers. In some embodiments the chimeric proteins comprise guided endonuclease proteins such as RNA guided endonucleases ("RGEN(s)"), including a Cas/CRISPR protein that are covalently fused to a partner protein with a set of universal peptide linkers. In additional embodiments, the fusion protein comprises rigid linker systems to fuse two proteins. In a further embodiment, the rigid linkers may be used for fusion proteins comprising a Cas protein fused to a fluorescent protein.

The fusion of Cas proteins of guided endonucleases to one or more unrelated protein partners is desirable for many reasons. For example, one embodiment includes the ability to generate CRISPR/Cas9 protein fusions to cleave double stranded DNA at precise locations in living cells. Cas9 is an RNA guided endonuclease from Clustered Regularly Interspaced Short Palindromic Repeat (CRISPR)-Cas (CRISPR-associated)) bacterial adaptive immune system of *Steptococcus pyogenes*. Cas9 is guided to a 23-nt DNA target sequence by a target site specific 20-nt complementary RNA (part of the 44-nt crRNA) and a universal 89-nt tracrRNA, collectively referred to as the guide RNA (gRNA) complex. The Cas9-gRNA ribonucleoprotein (RNP) complex mediates double-stranded DNA breaks (DSBs) which are then repaired by either the non-homologous end joining (NHEJ), which typically introduces mutations or indels at the cut site that frequently lead to gene disruption through frameshift mutation or the homology directed repair (HDR) system if a suitable template nucleic acid is present.

In one embodiment, a set of universal peptide linkers that have been specifically optimized for CRISPR enzyme fusions is desirable to improve the function of both Cas9 and the covalently-fused partner protein or protein domain. The universal linkers would not be specific to a Cas9 protein or any mutant variant thereof. In an additional embodiment, the CRISPR enzyme could be optimally linked with the universal linkers to a fluorescent protein.

In one embodiment, rigid linkers are used to covalently fuse two different proteins or protein domains. In one respect, the rigid linkers include $A(EAAAK)nA$ repeats that form an alpha helical structure to provide rigidity is used. In another respect, a $(XP)n$ repeat that forms relatively rigid extended rod like structures is used.

In a first aspect, a chimeric protein is provided. The chimeric protein includes a guided endonuclease protein, a rigid linker, and a second protein.

In a second aspect, a method of enriching cells having a chimeric protein is provided. The method includes several steps. The first step includes incubating a chimeric protein according to the first aspect with a guide RNA to form a RNP complex. The second step includes contacting the RNP complex to a plurality of target cells to produce recipient cells having the RNP complex. The third step includes sorting the recipient cells based on a fluorescence signal.

In a third aspect, an isolated nucleic acid encoding a chimeric protein is provided. The chimeric protein includes the chimeric protein of the first aspect.

In a fourth aspect, a chimeric protein is provided. The chimeric protein includes a guided endonuclease protein, a universal linker, and a second protein.

In a fifth aspect, an isolated nucleic acid is provided. The isolated nucleic acid encodes the chimeric protein according to any of respects of the fourth aspect.

In a sixth aspect, a method of enriching cells having a chimeric protein is provided. The method includes several steps. The first step includes incubating a chimeric protein according to any of the respects of the fourth aspect with a guide RNA to form a RNP complex. The second step includes contacting the RNP complex to a plurality of target cells to produce recipient cells having the RNP complex. The third step includes sorting the recipient cells based on a fluorescence signal.

DETAILED DESCRIPTION OF THE INVENTION

Figure 1A:
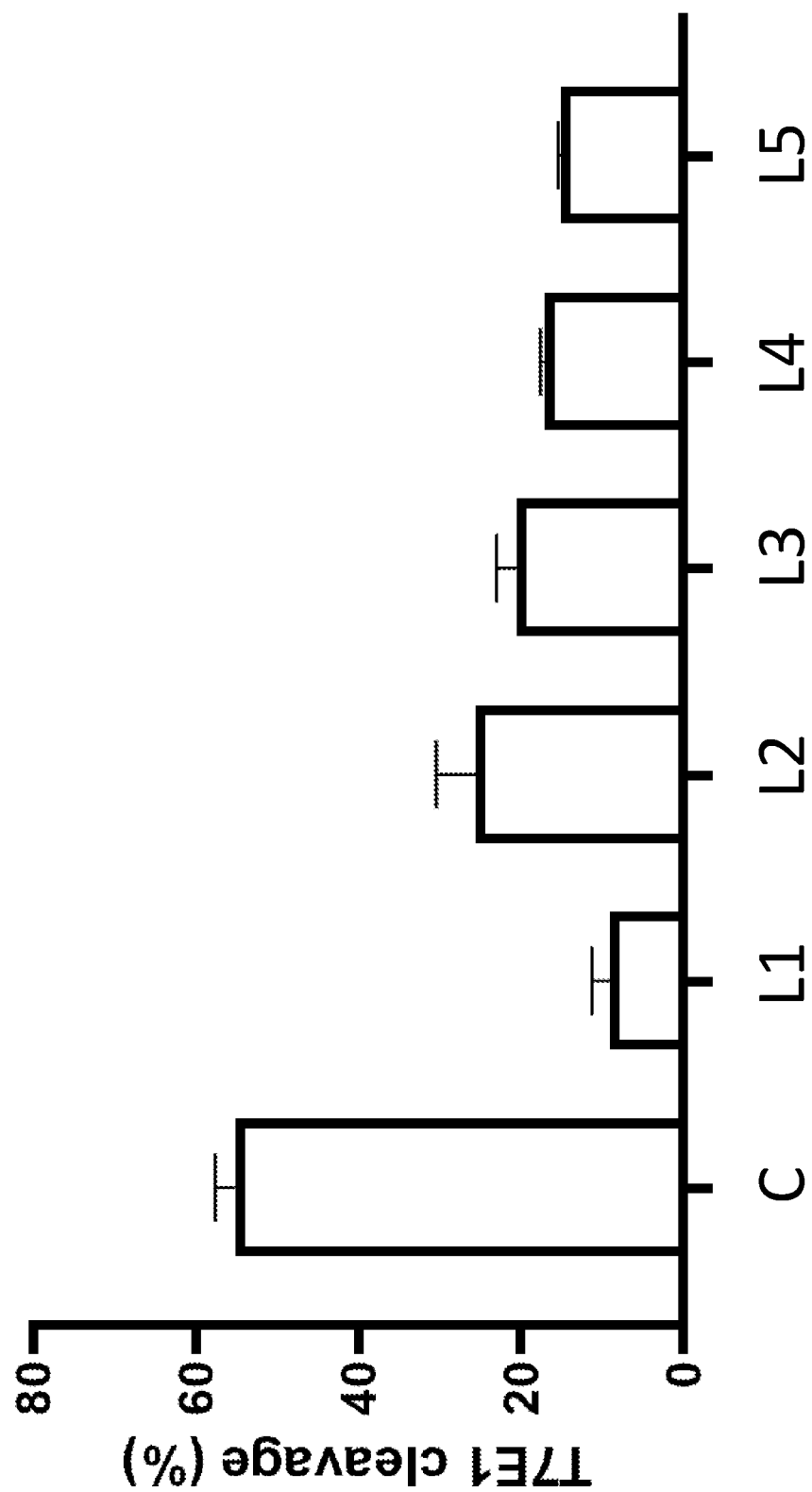
FIG. 1A depicts percent cleavage endonuclease activity of Cas9-eGFP linker variants (L1, Cas9-GSAGSAAGSGEF-eGFP (SEQ ID NO: 38); L2, Cas9-(AP)$_7$A-eGFP (SEQ ID NO: 49); L3, Cas9-A(EAAAK)$_4$A-eGFP (SEQ ID NO: 40); L4, Cas9-GGGGSEAAAKGGGG-eGFP (SEQ ID NO: 71) and L5, Cas9-(GGGGS)$_4$A-eGFP (SEQ ID NO: 39)) compared to untagged Cas9 protein (denoted as "C" (SEQ ID NO: 1)) delivered as plasmid (400 ng), with sgRNA guide targeting HPRT-38087 (SEQ ID NO: 324) delivered by reverse transfection 24 hours after plasmid delivery. The editing activity after 48 hours was measured by T7E1 assay.

The methods and compositions of the invention described herein provide for improved universal linkers for covalently fusing two or more proteins or protein domains. Additionally, the present invention describes methods of using the chimeric fusions. In particular, the disclosed chimeric proteins provide a robust manner whereby cells that contain the chimeric protein may be identified and sorted based upon the ability of the chimeric protein to generate a fluorescence signal. Moreover, not only do the chimeric proteins retain their enzymatic activity as guided endonucleases, but also several chimeric proteins possess surprisingly enhanced activity when compared to unmodified endonucleases or fusion proteins lacking a linker. These and other advantages of the invention, as well as additional inventive features, will be apparent from the description of the invention provided herein.

Definitions

The use of the terms "a" and "an" and "the" and similar referents in the context of describing the invention (especially in the context of the following claims) are to be construed to cover both the singular and the plural, unless otherwise indicated herein or clearly contradicted by context. The terms "comprising", "having", "including" and "containing" are to be construed as open-ended terms (i.e., meaning "including, but no limited to") unless otherwise noted. Recitation of ranges of values herein are merely intended to serve as a shorthand method of referring individually to each separate value falling within the range, unless otherwise indicated herein, and each separate value is incorporated into the specification as if it were individually recited herein. All methods described herein can be performed in any suitable order unless otherwise indicated herein or otherwise clearly contradicted by context. The use of any and all examples, or exemplary language (e.g., "such as") provided herein, is intended merely to better illuminate the invention and does not pose a limitation on the scope of the invention unless otherwise claimed. No language in the specification should be construed as indicating any non-claimed element as essential to the practice of the invention.

The term, "codon-optimized" as that term modifies "nucleic acid," "gene," "DNA," or "RNA," that encodes a protein or polypeptide, refers to a nucleic acid, gene, DNA or RNA that includes preferred codons for efficient expression of the protein or polypeptide in a given host cell or organism based upon the naturally occurring abundance of charged tRNA's specific for codons in that host cell or organism. By way of example, a codon-optimized Cas9 nucleic acid for E. coli will be suitable for optimal expression of the Cas9 protein when that nucleic acid is expressed in E. coli. Similarly, a codon-optimized Cas9 nucleic acid for human cells will be suitable for optimal expression of the Cas9 protein when that nucleic acid is expressed in a human cell. Exemplary codon-optimized nucleic acids are disclosed herein. A codon-optimized nucleic acid, gene, DNA, RNA can be readily generated from a naturally occurring endogenous DNA or RNA derived from the original host cell or organism or from reverse translation of the protein amino acid sequence for the relevant protein or polypeptide sequence. One of ordinary skill in the art would understand from the literature the codon bias or preference rules for a variety of host cells or organisms. Furthermore, codon-optimized nucleic acid conversion software programs are readily available online or generally known in the art.

The terms "RNA-guided endonuclease" and "RGEN" refer to a ribonucleoprotein endonuclease that includes an RNA component for targeted enzyme activity on a given substrate. Exemplary RGEN's include CRISPR-associated endonucleases.

The term "CRISPR" refers to Clustered Regularly Interspaced Short Palindromic Repeat bacterial adaptive immune system.

The terms "Cas" and "Cas endonuclease" generally refers to a CRISPR-associated endonuclease.

The term "Cas protein" generally refers to a wild-type protein, including a variant thereof, of a CRISPR-associated endonuclease (including the interchangeable terms Cas and Cas endonuclease).

The term "Cas nucleic acid" generally refers to a nucleic acid of a CRISPR-associated endonuclease, including a guide RNA, sgRNA, crRNA, or tracrRNA.

The terms "Cas9" and "CRISPR/Cas9" refer to the CRISPR-associated bacterial adaptive immune system of *Steptococcus pyogenes*.

The terms "AsCas12a" and "CRISPR/AsCas12a" refer to the CRISPR-associated bacterial adaptive immune system of *Acidaminococcus* sp.

The terms "LbCas12a" and "CRISPR/LbCas12a" refer to the CRISPR-associated bacterial adaptive immune system of Lachnospiraceae bacterium.

The term "Cas9 protein" refers to the protein of the Cas9 or CRISPR/Cas9 endonuclease system. For the purposes of this disclosure, the wild-type Cas9 protein amino acid sequence is SEQ ID NO: 1.

The term "AsCas12a protein" refers to the protein of the AsCas12a or CRISPR/AsCas12a endonuclease system. For the purposes of this disclosure, the wild-type AsCas12a protein amino acid sequence is SEQ ID NO: 2.

The term "LbCas12a protein" refers to the protein of the LbCas12a or CRISPR/LbCas12a endonuclease system. For the purposes of this disclosure, the wild-type LbCas12a protein amino acid sequence is SEQ ID NO: 3.

The term "Cas9 nucleic acid" refers to a nucleic acid (e.g., DNA or RNA) that encodes a Cas9 protein or polypeptide. A Cas9 nucleic acid can be selected from the naturally occurring nucleic acid from *Steptococcus pyogenes* or a codon-optimized nucleic acid for efficient expression in a given host cell or organism. For the purposes of this disclosure, exemplary codon-optimized versions of a Cas9 nucleic acid are SEQ ID NOS: 337 and 338.

The term "AsCas12a nucleic acid" refers to a nucleic acid (e.g., DNA or RNA) that encodes a AsCas12a protein or polypeptide. An AsCas12a nucleic acid can be selected from the naturally occurring nucleic acid from *Acidaminococcus* sp. or a codon-optimized nucleic acid for efficient expression in a given host cell or organism. For the purposes of this disclosure, exemplary codon-optimized versions of a AsCas12a nucleic acid are SEQ ID NOS: 339 and 340.

The term "LbCas12a nucleic acid" refers to a nucleic acid (e.g., DNA or RNA) that encodes a LbCas12a protein or polypeptide. A LbCas12a nucleic acid can be selected from the naturally occurring nucleic acid from Lachnospiraceae bacterium or a codon-optimized nucleic acid for efficient expression in a given host cell or organism. For the purposes of this disclosure, exemplary codon-optimized versions of a LbCas12a nucleic acid are SEQ ID NOS: 341 and 342.

The terms "guide RNA," "guide RNA complex" and "gRNA complex" refer to a target site-specific crRNA, a universal tracrRNA or a combination of both.

The term "sgRNA" refers to a guide RNA complex in which the crRNA is covalently linked to the tracrRNA in a single molecule.

The term "variant," as that term modifies a protein (for example, a Cas9 protein, AsCas12a protein or LbCas12a protein), refers to a protein that includes at least one amino substitution of the reference wild-type protein amino acid sequence, additional amino acids (for example, such as an affinity tag or nuclear localization signal), or a combination thereof. An exemplary LbCas12a protein variant amino acid sequence is LbCas12a (E795L) (SEQ ID NO: 310), and chimeric proteins comprising this amino acid sequence is presented in Tables V.7, V.8 and V.10.

The term ALT-R®, as that term modifies an RNA (for example, such as a crRNA, a tracrRNA, a guide RNA, or a sgRNA), refers to an isolated, chemically-synthesized, synthetic RNA.

The term ALT-R®, as that term modifies a protein (for example, such as a Cas9 protein, an AsCas12a protein, or a LbCas12a protein), refers to an isolated, recombinant protein.

The terms "fusion protein," "protein fusion," "chimeric protein," "protein chimera, "and "chimeric fusion protein" refer to a first protein or polypeptide having a covalent bond to at least one or more proteins or polypeptides, wherein the at least one or more proteins or polypeptides differ in primary sequence composition from the first protein or polypeptide. The terms fusion protein, protein fusion, chimeric protein, protein chimera and chimeric fusion protein have the same meaning and are used interchangeably. Exemplary fusion proteins are disclosed herein.

The term "universal," as applied to modify a "guide RNA," a "linker," or a "linker peptide, refers to a guide RNA, linker or linker peptide for use as a guide RNA, linker or linker peptide in more than one RGEN (as related to a guide RNA) or more than one fusion protein, (as related to a linker or linker peptide). Exemplary universal linkers and universal linker peptides include flexible linkers, rigid linkers and mixed linkers, including those linkers identified in Table I and references cited therein, which are incorporated by reference in their entirety.

The term "editing activity assay" refers to an assay to determine the extent of editing of a locus by an RGEN, such as a Cas endonuclease, on at least one locus targeted by the guide RNA. Exemplary editing activity assays include those selected from a T7EI assay and a Next Generation Sequencing (NGS) assay. Exemplary T7EI assay procedures are disclosed in U.S. patent application Ser. No. 14/975,709, filed Dec. 18, 2015, the contents of which are incorporated by reference herein. Exemplary NGS assays are disclosed in U.S. patent application Ser. No. 13/935,451, filed Jul. 3, 2013, the contents of which are incorporated by reference herein.

The terms "linker" and "linker polypeptide" refers to a polypeptide amino acid sequence of 2 or more amino acids that covalently join a first protein or polypeptide to a second protein polypeptide. Exemplary linkers and linker polypeptides are disclosed herein.

The term "rigid linker" refers to a linker that restricts at least one degree of freedom in the motion or conformation for an affected fusion protein, protein fusion, chimeric protein, or protein chimera that includes the linker. Exemplary rigid linkers are disclosed herein.

In a first embodiment a composition for an improved multi-functional chimeric protein and improved linkers is provided. In another respect the universal peptide linker is a rigid linker system.

In another embodiment, the rigid link is used to fuse two proteins, recombinant proteins, or protein domains into a single covalently fused protein construct. In one respect the Alpha helix forming linker with the sequence of $(EAAAK)n$ is used. In another respect the EAAAK amino acid sequence is repeated n times where n represents 1, 2, 3, 4, 5, 6, 7, 8, 9, 10, 11, 12, 13, or 14 repeats.

In another embodiment, the rigid linker is a Pro-rich sequence. In a further respect, the Pro-rich sequence is (XP)n with X designating any amino acid, including preferably Ala, Lys, or Glu and more preferably Alanine. In another respect, the XP sequence is repeated n times where n represent 1, 2, 3, 4, 5, 6, 7, 8, 9, 10, 11, 12, 13, or 14 repeats. In another respect, the number of repeats is preferably 5, 6, 7, 8, or 9 repeats. In another respect the number of repeats is more preferably 7 or 9 repeats.

In another embodiment, the rigid linker is a Pro-rich sequence. In a further respect, the Pro-rich sequence is (XP)nA with X designating any amino acid, including preferably Ala, Lys, or Glu and more preferably, Alanine and where the XP sequence is repeated n times in the range from 1-14 repeats, including n being 1, 2, 3, 4, 5, 6, 7, 8, 9, 10, 11, 12, 13, or 14 repeats. In another respect the number of repeats is preferably 5, 6, 7, 8, or 9 repeats. In another respect the number of repeats is more preferably 7 or 9 repeats.

In another embodiment, the rigid linker is used to covalently fuse a guided endonuclease and a second protein. In one respect, the rigid linker is used to covalently fuse the C-terminal end of a guided endonuclease to the N-terminal end of the second protein. Preferably, the rigid linker is used to covalently fuse the C-terminal of a RGEN to the N-terminal of a second protein. More preferably, the rigid linker is used to covalently fuse the C-terminal of a CRISPR-Cas to the N-terminal of a second protein.

In a further embodiment, the Pro-rich (XP)n rigid linker, where n is the repeat unit in the range from 1-14 repeats including n being 1, 2, 3, 4, 5, 6, 7, 8, 9, 10, 11, 12, 13, or 14 repeats, is used to covalently fuse the C-terminal end of a guided endonuclease to the N-terminal end of a second protein. Preferably, the (XP)n rigid linker is used to covalently fuse the C-terminal of a RGEN to the N-terminal of a second protein. More preferably, the (XP)n rigid linker is used to covalently fuse the C-terminal of a Cas protein to the N-terminal of a second protein.

In another embodiment, the Pro-rich sequence includes a (PX)nP rigid linker system, where n is the repeat unit in the range from 1-14 repeats including n being 1, 2, 3, 4, 5, 6, 7, 8, 9, 10, 11, 12, 13, or 14 repeats. In one respect, the Pro-rich sequence includes (PA)nP rigid linker system where n is the repeat unit in the range from 1-14 repeats including n being 1, 2, 3, 4, 5, 6, 7, 8, 9, 10, 11, 12, 13, or 14 repeats. In another respect, the Pro-rich sequence includes $(PA)_6P$ rigid linker system.

In another embodiment, the rigid linker is used to covalently fuse the C-terminal end of a first protein to the N-terminal of guided endonuclease. In another respect, the rigid linker is used to covalently fuse the C-terminal of a first protein to the N-terminal of a RGEN. In another respect, the rigid linker is used to covalently fuse the C-terminal of a first protein to the N-terminal of a Cas protein.

In another embodiment, the Pro-rich (XP)n rigid linker is used to covalently fuse the C-terminal end of a first protein to the N-terminal of guided endonuclease. In another respect, the (XP)n linker is used to covalently fuse the C-terminal of a first protein to the N-terminal of a RGEN. In another respect the (XP)n rigid linker is used to covalently fuse the C-terminal of a first protein to the N-terminal of a Cas protein.

In another embodiment, the CRISPR/Cas9 protein is one of the proteins covalently fused to the rigid linker. In one respect, the Cas9 protein may be a wild type Cas9 protein. In another respect the Cas protein may be a mutant or variant protein.

In another embodiment, the first protein is a guided endonuclease joined through a rigid linker to a fluorescent protein. Preferably, the guided endonuclease is an RGEN and more preferably is a CRISPR/Cas enzyme. In one respect, the fluorescent protein is eGFP or mCherry. In another aspect, the CRISPR/Cas enzyme is covalently linked to the fluorescent protein with a rigid linker to generate a CRISPR/Cas fluorescent chimeric fusion protein. The CRISPR/Cas fluorescent fusion protein allows for the ability to visualize and monitor successful delivery of CRISPR/Cas reagents into the target cell nucleus or nucleolus. In another respect, the cells may be sorted and enriched for based on the detection of the fluorescent fusion protein.

In a first aspect, a chimeric protein is provided. The chimeric protein includes a guided endonuclease protein, a rigid linker, and a second protein. In a first respect, the guided endonuclease protein is a Cas protein. In a second respect, the Cas protein is selected from the group consisting of Cas9 protein, AsCas12a protein, LbCas12a protein and a variant of Cas9 protein, AsCas12a protein, or LbCas12a protein. In a third respect, the Cas protein is selected from the group comprising SEQ ID NOS: 1, 2, and 3. In a fourth respect, the Cas protein is preferably SEQ ID NO: 1. In a fifth respect, the Cas protein is preferably SEQ ID NO: 2. In a sixth respect, the Cas protein is preferably SEQ ID NO: 3. In a seventh respect, the second protein is a fluorescent protein. In an eighth respect, the fluorescent protein is selected from the group comprising SEQ ID NOS: 4 and 5. In a ninth respect, the fluorescent protein is SEQ ID NO: 4. In a tenth respect, the fluorescent protein is SEQ ID NO: 5. In an eleventh respect, the rigid linker is selected from the group comprising XP, APA, and SEQ ID NOS: 8, 11-23 and 24-36. In a twelve respect, the rigid linker is SEQ ID NO: 8. In a thirteenth respect, the rigid linker is selected from the group comprising XP and SEQ ID NOS: 24-36. In a fourteenth respect, the rigid linker is selected from SEQ ID NOS: 29-31. In a fifteenth respect, the rigid linker is selected from the group comprising APA and SEQ ID NOS: 11-23. In a sixteenth respect, the rigid linker is selected from the group comprising APA and SEQ ID NOS: 17-18. In an eighteenth respect, the chimeric protein is selected from the group that includes SEQ ID NOS: 40-70, 74-104, 108-138, 142-172, 176-206, 210-240, 244-274, and 278-308.

In a second aspect, a method of enriching cells having a chimeric protein is provided. The method includes several steps. The first step includes incubating a chimeric protein according to the first aspect with a guide RNA to form a RNP complex. The second step includes contacting the RNP complex to a plurality of target cells to produce recipient cells having the RNP complex. The third step includes sorting the recipient cells based on a fluorescence signal. In a first respect, the method includes an additional step of performing an editing activity assay on at least one locus targeted by the guide RNA. In a second respect, the step of performing an editing activity assay on at least one locus targeted by the guide RNA is selected from an T7EI assay and a Next Generation Sequencing assay. In a third respect, the method includes a chimeric protein selected from the group consisting of SEQ ID NOS: 40-70, 74-104, 108-138, 142-172, 176-206, 210-240, 244-274, and 278-308.

In a third aspect, an isolated nucleic acid encoding a chimeric protein is provided. The chimeric protein includes the chimeric protein of the first aspect. In a first respect, the chimeric protein comprises a member selected from the group consisting of SEQ ID NOS: 40-70, 74-104, 108-138, 142-172, 176-206, 210-240, 244-274, and 278-308. In a second respect, wherein the isolated nucleic acid is codon optimized for expression in an organism or host cell. In a third respect, the organism or host cell is selected from *E. coli* or *H. sapiens*.

In a fourth aspect, a chimeric protein is provided. The chimeric protein includes a guided endonuclease protein, a universal linker, and a second protein. In a first respect, the guided endonuclease protein is a Cas protein. In a second respect, the Cas protein is selected from the group consisting of Cas9 protein, AsCas12a protein, LbCas12a protein, and a variant of Cas9 protein, AsCas12a protein, and LbCas12a protein. In a third respect, the Cas protein is selected from the group comprising SEQ ID NOS: 1, 2, and 3. In a fourth respect, the Cas protein is SEQ ID NO: 1. In a fifth respect, the Cas protein is SEQ ID NO: 2. In a sixth respect, the Cas protein is SEQ ID NO: 3. In a seventh respect, the second protein is a fluorescent protein. In a eighth respect, the fluorescent protein is selected from the group comprising SEQ ID NOS: 4 and 5. In a ninth respect, the fluorescent protein is SEQ ID NO: 4. In a tenth respect, the fluorescent protein is SEQ ID NO: 5. In an eleventh respect according to any of the previous respects of the fourth aspect, the universal linker is selected from a flexible linker, a rigid linker, and a mixed linker. In a twelfth respect, the universal linker comprises a flexible linker selected from the group consisting of SEQ ID NOS: 6 and 7. In a thirteenth respect, the universal linker comprises a rigid linker selected from the group consisting of XP, APA, and SEQ ID NOS: 8-36. In a fourteenth respect, the universal linker comprises a mixed linker of SEQ ID NOS: 37. In a fifteenth respect, the chimeric protein is selected from the group consisting of SEQ ID NOS: 38-309.

In a fifth aspect, an isolated nucleic acid is provided. The isolated nucleic acid encodes the chimeric protein according to any of respects of the fourth aspect. In a first respect, the isolated nucleic acid is codon optimized for expression in an organism or host cell. In a second respect, the organism or host cell is selected from *E. coli* or *H. sapiens*. In a third respect, the isolated nucleic acid is selected from the group consisting of SEQ ID NOS: 348-387 and 389-429.

In a sixth aspect, a method of enriching cells having a chimeric protein is provided. The method includes several steps. The first step includes incubating a chimeric protein according to any of respects of the fourth aspect with a guide RNA to form a RNP complex. The second step includes contacting the RNP complex to a plurality of target cells to produce recipient cells having the RNP complex. The third step includes sorting the recipient cells based on a fluorescence signal. In a first respect, the method includes an additional step of performing an editing activity assay on at least one locus targeted by the guide RNA. In a second respect, the step of performing an editing activity assay on at least one locus targeted by the guide RNA is selected from an T7EI assay and a Next Generation Sequencing assay.

Example 1

Linker Effect on Editing Efficiency of Recombinant Cas9

This example identifies linkers that improve Cas9-eGFP activity. Nineteen separate plasmids that express recombinant versions of Cas9 in mammalian cells were constructed wherein the encoded protein has eGFP positioned downstream of the Cas9 carboxy-terminal domain (CTD) and the peptide sequence between Cas9 and eGFP were varied (Table I).

TABLE I

List of linker sequences.

| SEQ ID NO: | Linker Sequence | Type |
|---|---|---|
| 6 | GSAGSAAGSGEF | Flexible[1] |
| 7 | GGGGSGGGGSGGGGSGGGGS | Flexible[2] |
| 8 | AEAAAKEAAAKEAAAKEAAAKA | Rigid[3] |
| 9 | AEAAAKEAAAKEAAAKEAAAKALEAEAAA KEAAAKEAAAKA | Rigid[3] |
| 10 | LEAEAAAKEAAAKEAAAKEAAAKALEAEA AAKEAAAKEAAAKEAAAKALE | Rigid[3] |
| — | APA | Rigid[4] |
| 11 | APAPA | Rigid[4] |
| 12 | APAPAPA | Rigid[4] |
| 13 | APAPAPAPA | Rigid[4] |
| 14 | APAPAPAPAPA | Rigid[4] |
| 15 | APAPAPAPAPAPA | Rigid[4] |
| 16 | APAPAPAPAPAPAPA | Rigid[4] |
| 17 | APAPAPAPAPAPAPAPA | Rigid[4] |
| 18 | APAPAPAPAPAPAPAPAPA | Rigid[4] |
| 19 | APAPAPAPAPAPAPAPAPAPA | Rigid[4] |
| 20 | APAPAPAPAPAPAPAPAPAPAPA | Rigid[4] |
| 21 | APAPAPAPAPAPAPAPAPAPAPAPA | Rigid[4] |
| 22 | APAPAPAPAPAPAPAPAPAPAPAPAPA | Rigid[4] |
| 23 | APAPAPAPAPAPAPAPAPAPAPAPAPAPA | Rigid[4] |
| — | XP | Rigid[4] |
| 24 | XPXP | Rigid[4] |
| 25 | XPXPXP | Rigid[4] |
| 26 | XPXPXPXP | Rigid[4] |
| 27 | XPXPXPXPXP | Rigid[4] |
| 28 | XPXPXPXPXPXP | Rigid[4] |
| 29 | XPXPXPXPXPXPXP | Rigid[4] |
| 30 | XPXPXPXPXPXPXPXP | Rigid[4] |
| 31 | XPXPXPXPXPXPXPXPXP | Rigid[4] |
| 32 | XPXPXPXPXPXPXPXPXPXP | Rigid[4] |
| 33 | XPXPXPXPXPXPXPXPXPXPXP | Rigid[4] |
| 34 | XPXPXPXPXPXPXPXPXPXPXPXP | Rigid[4] |
| 35 | XPXPXPXPXPXPXPXPXPXPXPXPXP | Rigid[4] |
| 36 | XPXPXPXPXPXPXPXPXPXPXPXPXPXP | Rigid[4] |
| 37 | GGGGSEAAAKGGGGS | Mixed[5] |

[1] Waldo 1999;
[2] Gergeron 2009;
[3] Bae and Shen 2006;
[4] McCormick 2001;
[5] Chen 2017

The constructs were first assayed through expression from plasmids delivered into HEK293 cells with editing assayed after 48-72 hours by T7EI digestion. Constructs showing improved activity were then subcloned into vectors for protein expression in E. coli and recombinant Cas9-fluorescent protein fusion proteins were purified by immobilized metal affinity chromatography followed by ion exchange chromatography. Purified proteins were tested for Cas9 endonuclease activity when delivered as RNP into HEK293 cells with editing assayed after 48 hours by T7 Endonuclease (T7EI) digestion.

The editing efficiency of the 19 different recombinant versions of Cas9 protein when expressed form transiently transfected plasmid in HEK293 was determined. Additionally, for a subset of the constructs were delivered as RNP. The methods and compositions disclosed herein identify linkers that result in improved editing efficiency over a baseline flexible linker design. Rigid linkers of both Pro-rich sequence (XP)n and EAAAK repeat varieties were found to result in an increase in Cas9 activity when delivered as plasmid. Additionally, it was found that certain (XP)n repeat structures showed improvement in editing activity when delivered as RNP.

Example 2

Cas9-eGFP Proteins with Rigid Linkers Expressed from Plasmids Demonstrate Improved Editing Efficiency This example demonstrates that introduction of rigid linkers between Cas9 and eGFP results in an improvement in Cas9 editing activity of a Cas9-eGFP fusion protein when expressed inhuman cells from transfected plasmid. The set of rigid and flexible linkers that were generate in Example 1 were further tested in the context of Cas9-linker-eGFP to assess their impact on Cas9 activity.

The editing activity of Cas9-eGFP fusion proteins containing either rigid helical [A(EAAAK)$_4$A] (linker SEQ ID NO: 8), rigid alanine-proline [(AP)$_7$A] (linker SEQ ID NO: 16), flexible (GGGGS)$_4$ (linker SEQ ID NO: 7), or a mixed flexibility linker GGGGSEAAAKGGGGS (linker SEQ ID NO: 37) were compared to wild-type Cas9 protein and the Cas9-eGFP protein with a flexible GSAGSAAGSGEF (Abbreviated GSA; linker SEQ ID NO: 6) linker serving as a baseline for comparison of editing activity. Fusion proteins were expressed from plasmids using a CMV promoter in HEK293 cells. Plasmids were delivered using the Lonza Nucleofector 96-well shuttle, using SF cell line solution, on setting DS-150 with 400 ng protein expression plasmid and 350,000 cells per well, with cells split into three wells following transfection. Two sgRNAs (HPRT-38087 (SEQ ID NO: 324) and HPRT-38285 (SEQ ID NO: 326)) targeting positions within the HPRT1 gene region were delivered at a final concentration of 30 nM by reverse transfection 24 hours after plasmid delivery using Lipofectamine RNAi Max. To analyze editing activity, genomic DNA was extracted 48 hours after reverse transfection using QuickExtract™ DNA extraction solution. Editing was assayed by PCR amplifying an ~1 kb region of the HPRT1 gene containing target cleavage sites, melting and re-hybridizing the PCR products, digesting the products with T7EI, and quantifying the proportion of cleaved to full length sequence using the Fragment Analyzer (Agilent).

Figure 1B:
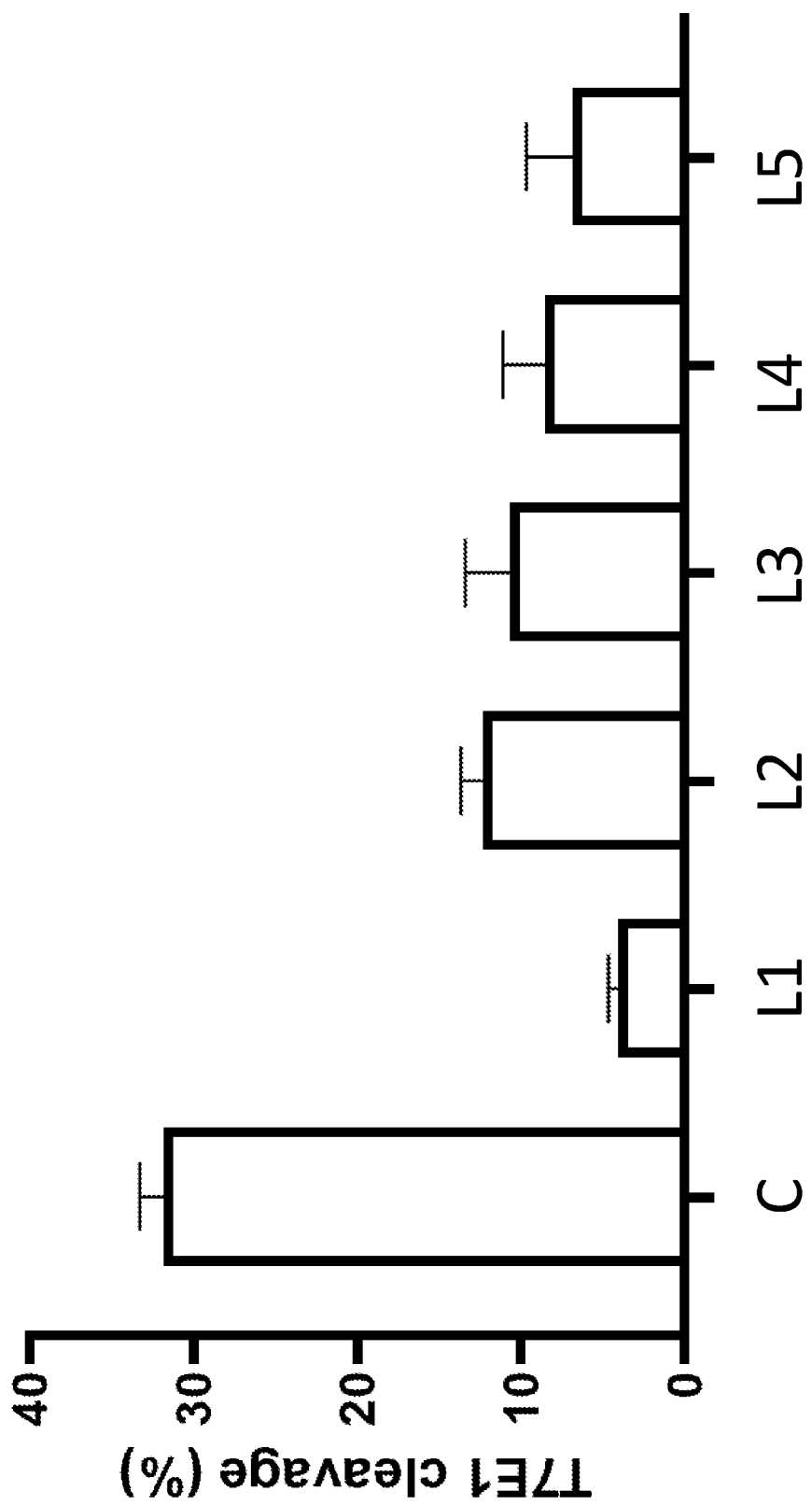
FIG. 1B depicts percent cleavage endonuclease activity of Cas9-eGFP linker variants (L1, Cas9-GSAGSAAGSGEF-eGFP (SEQ ID NO: 38); L2, Cas9-(AP)$_7$A-eGFP (SEQ ID NO: 49; L3, Cas9-A(EAAAK)$_4$A-eGFP (SEQ ID NO: 40); L4, Cas9-GGGGSEAAAKGGGG-eGFP (SEQ ID NO: 71) and L5, Cas9-(GGGGS)$_4$A-eGFP (SEQ ID NO: 39)) compared to untagged Cas9 protein (denoted as "C" (SEQ ID NO: 1)) delivered as plasmid (400 ng), with sgRNA guide targeting HPRT-38285 (SEQ ID NO: 326) delivered by reverse transfection 24 hours after plasmid delivery. The editing activity after 48 hours was measured by T7E1 assay.

The results are shown in FIG. 1 with error bars representing the standard deviation between the three biological samples. While all four linkers resulted in improved activity over the baseline GSA linker, both types of rigid linkers resulted in an improvement in editing activity.

Example 3

To further test rigid linkers, another experiment was performed using the same protocol as in Example 2. A set of 12 different gRNAs (Table II) targeting positions within the HPRT1 gene were tested. The PCR Primers are provided in Table III.

TABLE II

List of protospacer sequences of sgRNAs

| SEQ ID NO: | ALT-R ® Sequence (5'→3') | Name |
|---|---|---|
| 319 | rUrCrCrArUrUrUrCrArUrArGrUrCrU rUrUrCrCrUrGrUrUrUrUrArGrArGrC rUrArUrGrCrU | HRPT 38094 S-m36 |
| 320 | rUrUrUrUrGrUrArArUrArArCrArG rCrUrUrGrCrGrUrUrUrUrArGrArGrC rUrArUrGrCrU | HRPT 38231 S-m36 |
| 321 | rCrUrUrArGrArGrArArUrArUrUrG rUrArGrArGrGrUrUrUrUrArGrArGrC rUrArUrGrCrU | HRPT 38371 S-m36 |
| 322 | rUrUrGrArCrUrArUrArArUrGrArArU rArCrUrUrCrGrUrUrUrUrArGrArGrC rUrArUrGrCrU | HRPT 38509 S-m36 |
| 323 | rCrArArArArCrArCrArGrCrArUrArA rArArUrUrGrUrUrUrUrArGrArGrC rUrArUrGrCrU | HRPT 38574 S-m36 |
| 324 | rArArUrArUrGrGrGrArUrUrArC rUrArGrGrArGrUrUrUrUrArGrArGrC rUrArUrGrCrU | HRPT 38087 AS-m36 |
| 325 | rGrGrUrCrArCrUrUrUrArArCrArC rArCrCrCrArGrUrUrUrUrArGrArGrC rUrArUrGrCrU | HRPT 38133 AS-m36 |
| 326 | rCrUrUrArUrArUrCrCrArArCrArCrU rUrCrGrUrGrUrUrUrUrArGrArGrC rUrArUrGrCrU | HRPT 38285 AS-m36 |
| 327 | rGrGrCrUrUrArUrArUrCrCrArArCrA rCrUrUrCrGrUrUrUrUrArGrArGrC rUrArUrGrCrU | HRPT 38287 AS-m36 |
| 328 | rArUrUrUrCrArCrArUrArArArArCrU rCrUrUrUrGrUrUrUrUrArGrArGrC rUrArUrGrCrU | HRPT 38358 AS-m36 |
| 329 | rUrCrArArArUrUrArUrGrArGrGrUrG rCrUrGrGrArUrUrUrUrArGrArGrC rUrArUrGrCrU | HRPT 38636 AS-m36 |
| 330 | rUrArCrArGrCrUrUrUrArUrGrUrGrA rCrUrArArUrGrUrUrUrArGrArGrC rUrArUrGrCrU | HRPT 38673 AS-m36 |

TABLE III

List of Primers

| SEQ ID NO: | Sequence (5'→3') | Name |
|---|---|---|
| 331 | AAGAATGTTGTGATAAAAGGTGATGCT | HRPT Low GC 7 FWD |
| 332 | ACACATCCATGGGACTTCTGCCTC | HRPT Low GC 7 REV |

Figure 2:
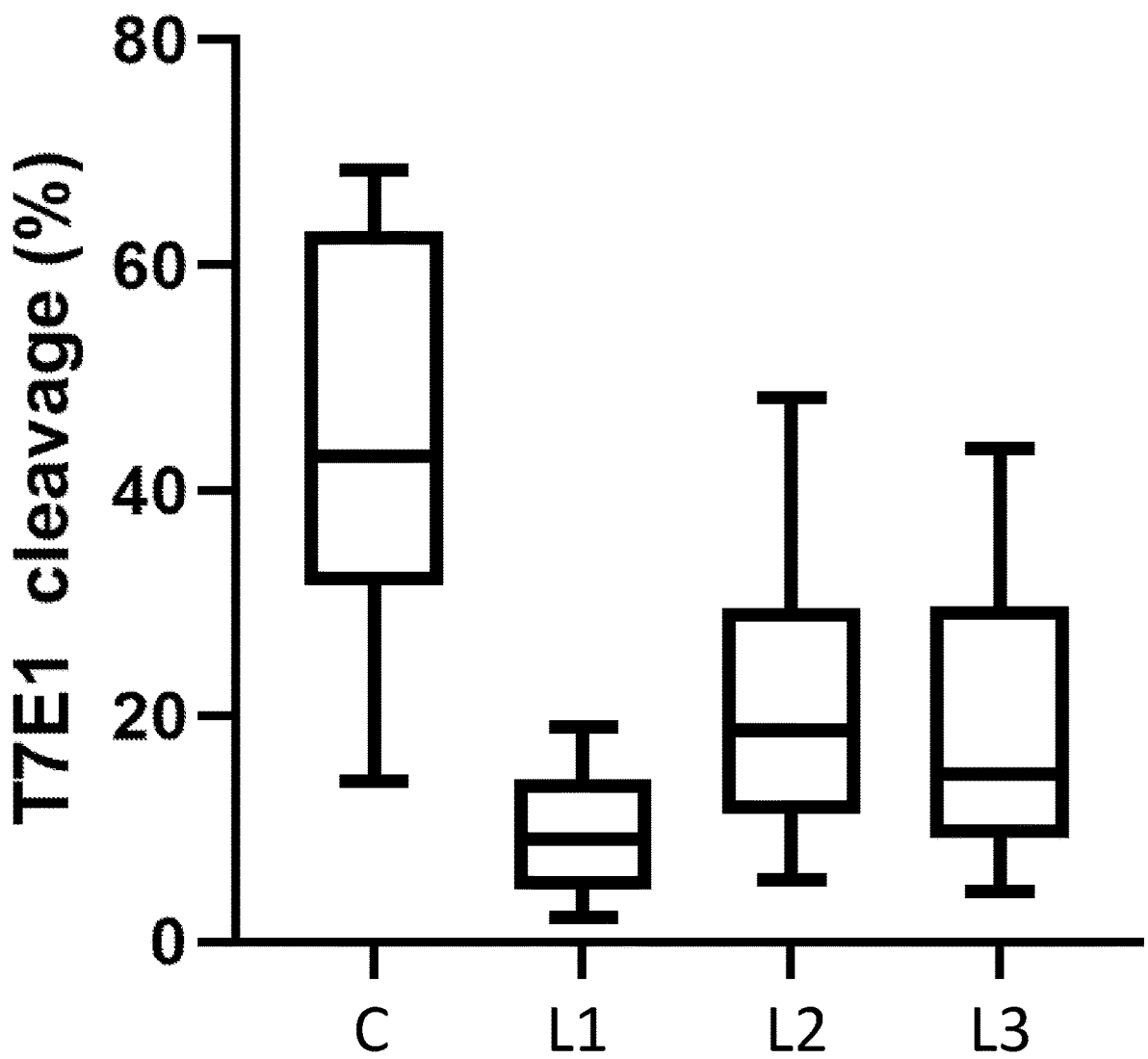
FIG. 2 depicts percent editing efficiency of plasmid expressed Cas9-eGFP linker variants (Cas9-GSAGSAAGSGEF-eGFP (SEQ ID NO: 38); Cas9-(AP)$_7$A-eGFP (SEQ ID NO: 49); and Cas9-A(EAAAK)$_4$A-eGFP (SEQ ID NO: 40)) compared to untagged Cas9 protein (SEQ ID NO: 1), with gRNA delivered into HEK293 cells by reverse transfection 24 hours after plasmid delivery. The data are displayed as box and whiskers plots showing the aggregated cleavage efficiency over 12 gRNAs that target distinct loci with HPRT (SEQ ID NOS: 319-330). Cleavage efficiency was measured with T7EI assay 48 hours after transfection.

The results are shown in FIG. 2. The rigid linkers provided varying levels of improvement depending on the targeted site over the original GSA linker design, with both linkers providing improvement at each site.

Example 4

This example demonstrates the effect of linker length by varying the number of alanine-proline repeats between 1 and 14 (APA and linker SEQ ID NOS: 11-23) and testing two different extend helical linker designs. This experiments follows the same protocol as established in Example 2; however, the guide RNA was expressed from plasmid co-delivered at 100 ng per well and the cells were allowed to grow for three days before collecting genomic DNA.

Figure 3A:
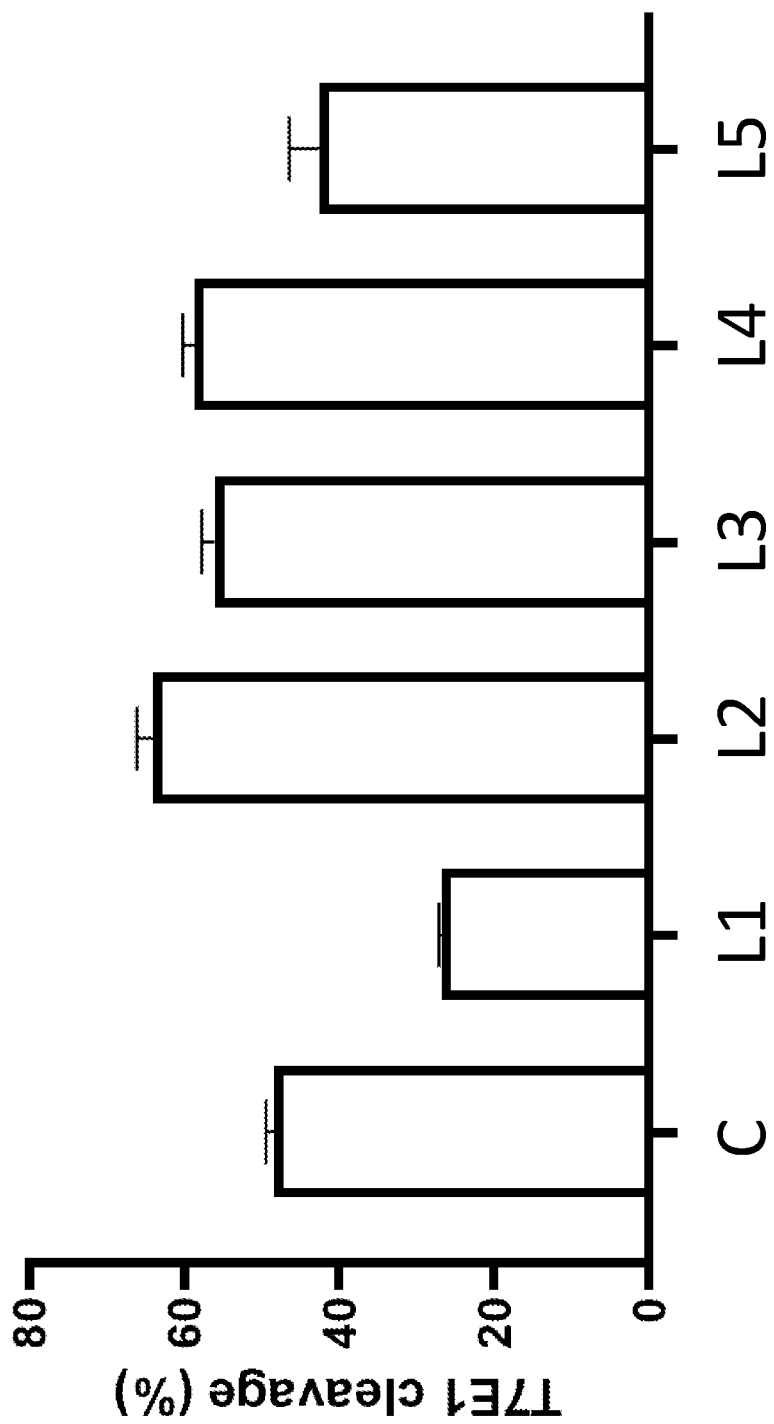
FIG. 3A depicts editing efficiency of plasmid-expressed Cas9-eGFP linker variants (L1, Cas9-GSAGSAAGSGEF-eGFP (SEQ ID NO: 38); L2, Cas9-(AP)$_7$A-eGFP (SEQ ID NO: 49); L3, Cas9-A(EAAAK)$_4$A-eGFP (SEQ ID NO: 40); L4, Cas9-A(EAAAK)$_4$ALEA(EAAAK)$_4$A-eGFP (SEQ ID NO: 41); and L5, Cas9-LEA(EAAAK)$_4$ALEA(EAAAK)$_4$ALE-eGFP (SEQ ID NO: 42)) compared to untagged Cas9 protein (denoted as "C," SEQ ID NO: 1) co-delivered with an sgRNA expression plasmid into HEK293 cells by electroporation, wherein the expressed sgRNA targeted HPRT-38087 (SEQ ID NO: 324). T7E1 cleavage assays were performed on each transfected cell population 72 hours after transfection of both plasmids into the HEK293 cells.
Figure 3B:
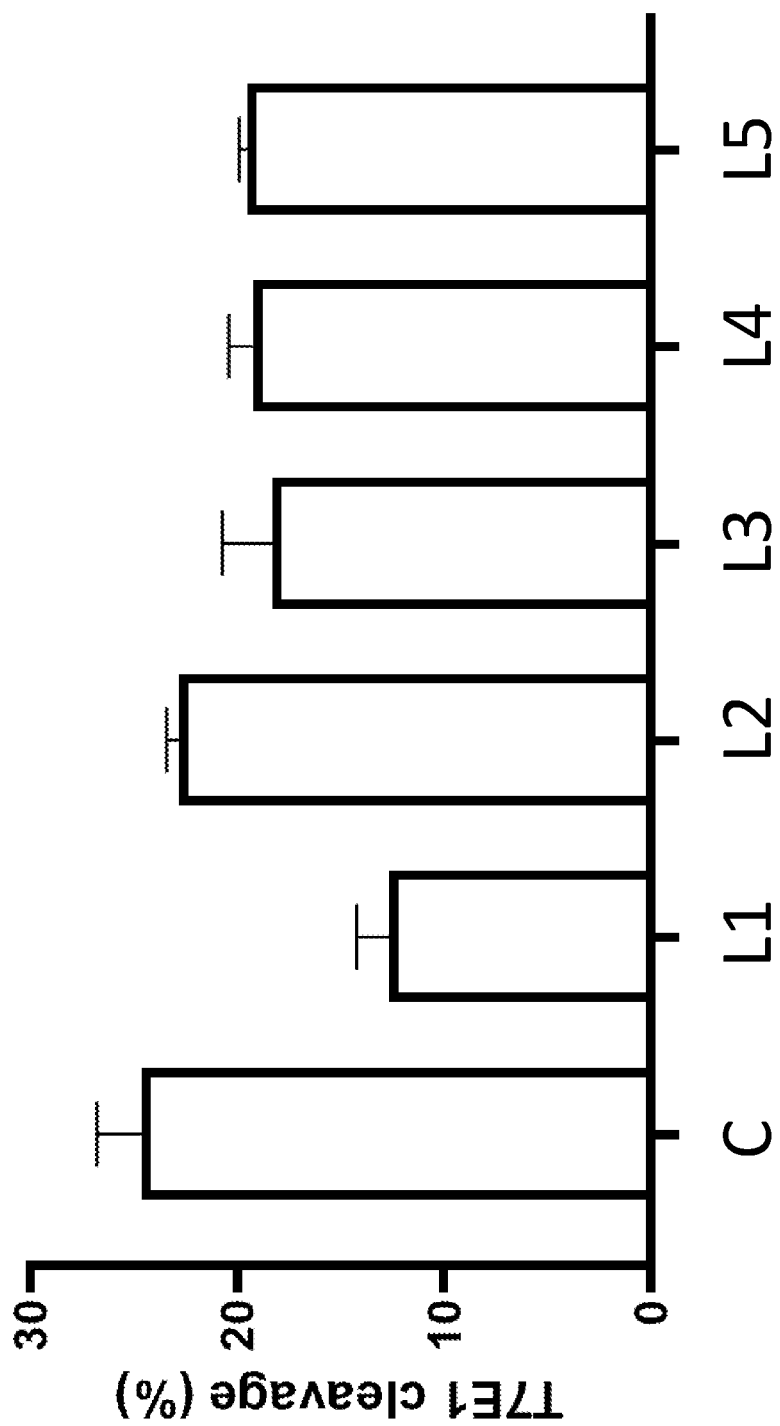
FIG. 3B depicts editing efficiency of plasmid-expressed Cas9-eGFP linker variants (L1, Cas9-GSAGSAAGSGEF-eGFP (SEQ ID NO: 38); L2, Cas9-(AP)$_7$A-eGFP (SEQ ID NO: 49); L3, Cas9-A(EAAAK)$_4$A-eGFP (SEQ ID NO: 40); L4, Cas9-A(EAAAK)$_4$ALEA(EAAAK)$_4$A-eGFP (SEQ ID NO: 41); and L5, Cas9-LEA(EAAAK)$_4$ALEA(EAAAK)$_4$ALE-eGFP (SEQ ID NO: 42)) compared to untagged Cas9 protein (denoted as "C," SEQ ID NO: 1) co-delivered with an sgRNA expression plasmid into HEK293 cells by electroporation, wherein the expressed sgRNA targeted HPRT-38285 (SEQ ID NO: 326). T7E1 cleavage assay was performed 72 hours after transfection of both plasmids into the HEK293 cells.
Figure 4A:
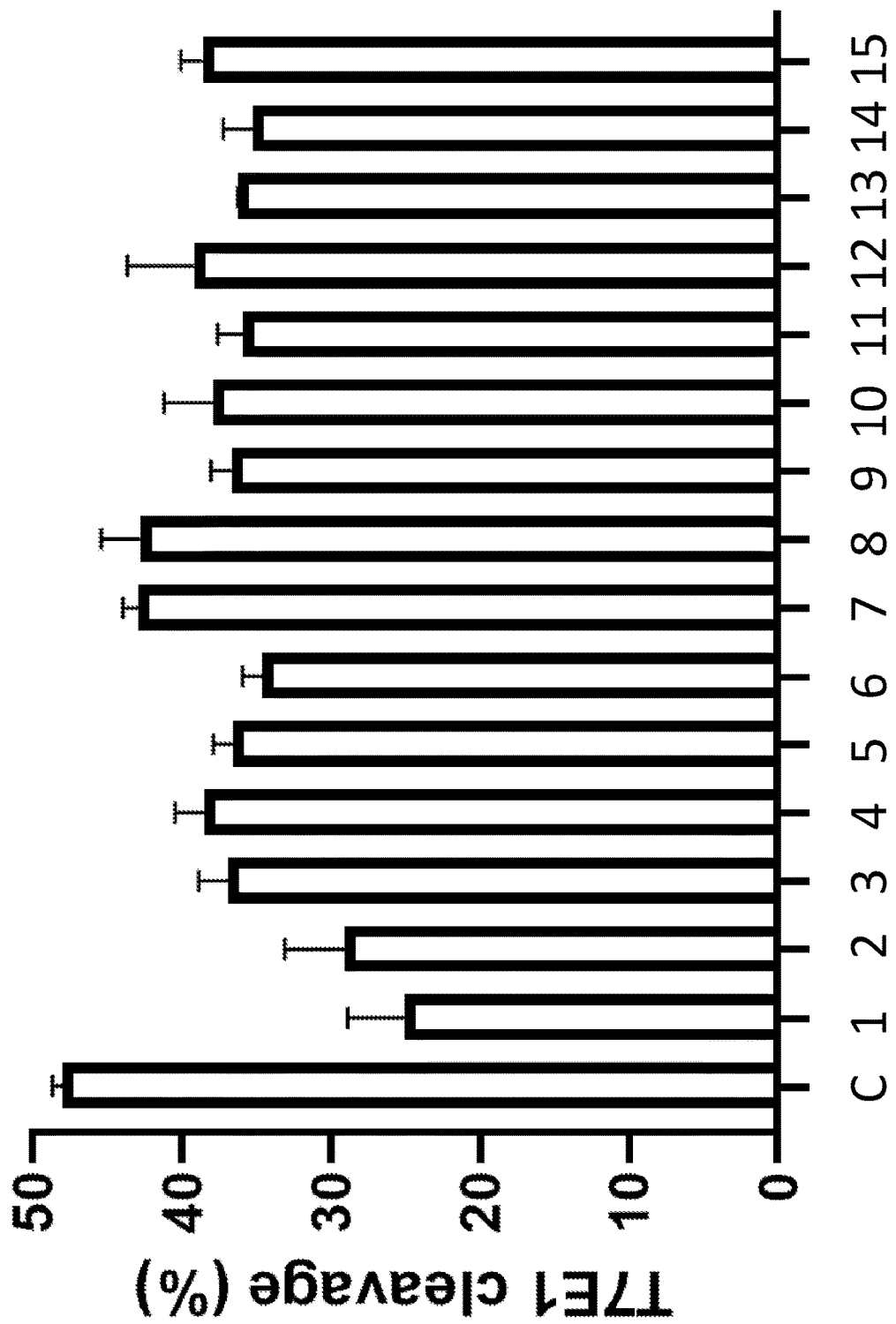
FIG. 4A depicts editing efficiency of plasmid expressed Cas9-eGFP linker variants (1, Cas9-GSAGSAAGSGEF-eGFP (SEQ ID NO: 38); 2, Cas9-APA-eGFP (SEQ ID NO: 43); 3, Cas9-(AP)$_2$A-eGFP (SEQ ID NO: 44); 4, Cas9-(AP)$_3$A-eGFP (SEQ ID NO: 45); 5, Cas9-(AP)$_4$A-eGFP (SEQ ID NO: 46); 6, Cas9-(AP)$_5$A-eGFP (SEQ ID NO: 47); 7, Cas9-(AP)$_6$A-eGFP (SEQ ID NO: 48); 8, Cas9-(AP)$_7$A-eGFP (SEQ ID NO: 49); 9, Cas9-(AP)$_8$A-eGFP (SEQ ID NO: 50); 10, Cas9-(AP)$_9$A-eGFP (SEQ ID NO: 51); 11, Cas9-(AP)$_{10}$A-eGFP (SEQ ID NO: 52); 12, Cas9-(AP)$_{11}$A-eGFP (SEQ ID NO: 53); 13, Cas9-(AP)$_{12}$A-eGFP (SEQ ID NO: 54); 14, Cas9-(AP)$_{13}$A-eGFP (SEQ ID NO: 55); and 15, Cas9-(AP)$_{14}$A-eGFP (SEQ ID NO: 56)) compared to untagged Cas9 protein (denoted as "C," SEQ ID NO: 1), co-delivered with sgRNA expression plasmid into HEK293 cells by electroporation, wherein the expressed sgRNA targeted HPRT-38087 (SEQ ID NO: 324). T7E1 cleavage assay was performed 72 hours after transfection of both plasmids into the HEK293 cells.
Figure 4B:
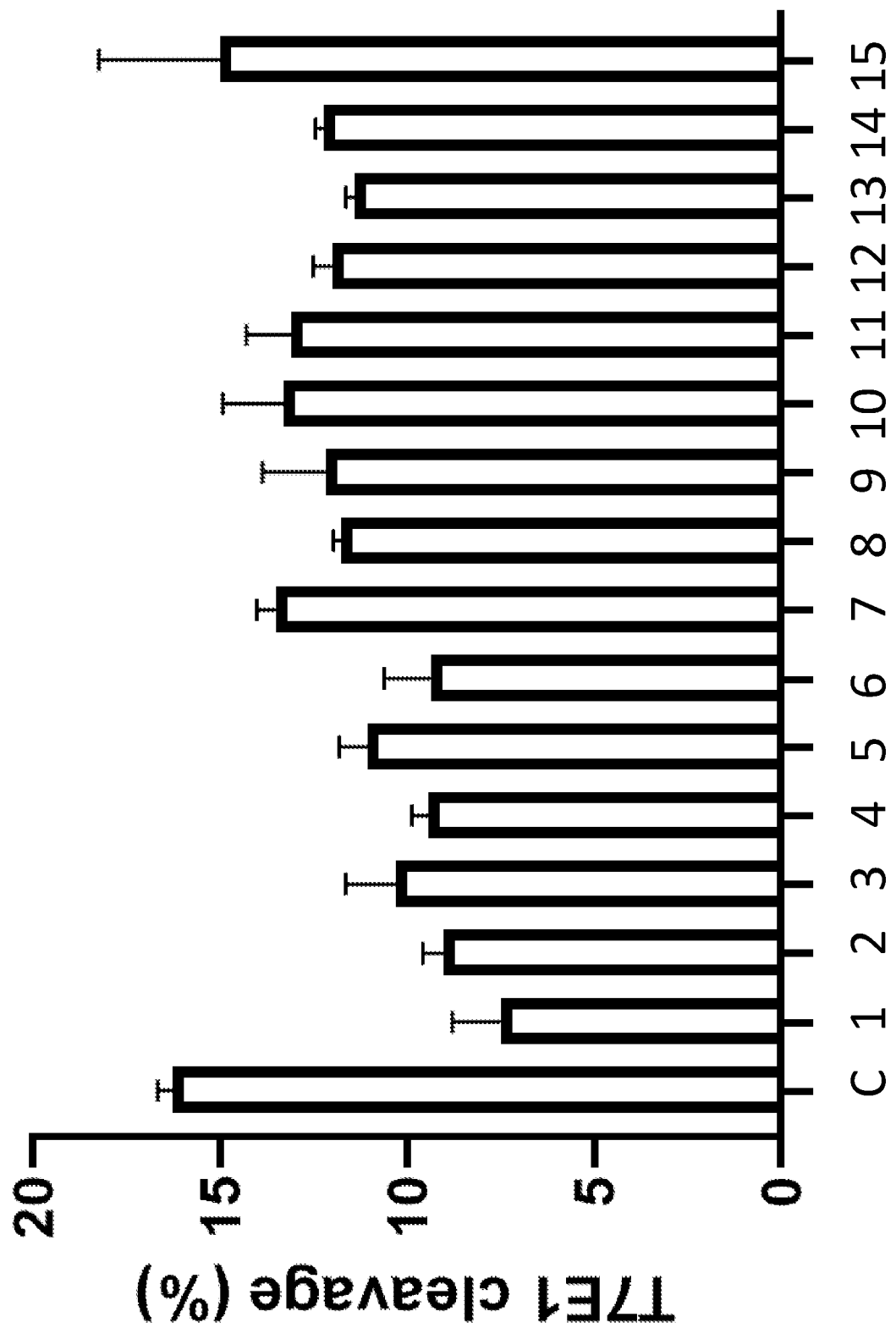
FIG. 4B depicts editing efficiency of plasmid expressed Cas9-eGFP linker variants (1, Cas9-GSAGSAAGSGEF-eGFP (SEQ ID NO: 38); 2, Cas9-APA-eGFP (SEQ ID NO: 43); 3, Cas9-(AP)$_2$A-eGFP (SEQ ID NO: 44); 4, Cas9-(AP)$_3$A-eGFP (SEQ ID NO: 45); 5, Cas9-(AP)$_4$A-eGFP (SEQ ID NO: 46); 6, Cas9-(AP)$_5$A-eGFP (SEQ ID NO: 47); 7, Cas9-(AP)$_6$A-eGFP (SEQ ID NO: 48); 8, Cas9-(AP)$_7$A-eGFP (SEQ ID NO: 49); 9, Cas9-(AP)$_8$A-eGFP (SEQ ID NO: 50); 10, Cas9-(AP)$_9$A-eGFP (SEQ ID NO: 51); 11, Cas9-(AP)$_{10}$A-eGFP (SEQ ID NO: 52); 12, Cas9-(AP)$_{11}$A-eGFP (SEQ ID NO: 53); 13, Cas9-(AP)$_{12}$A-eGFP (SEQ ID NO: 54); 14, Cas9-(AP)$_{13}$A-eGFP (SEQ ID NO: 55); and 15, Cas9-(AP)$_{14}$A-eGFP (SEQ ID NO: 56)) compared to untagged Cas9 protein (denoted as "C," SEQ ID NO: 1), co-delivered with sgRNA expression plasmid into HEK293 cells by electroporation, wherein the expressed sgRNA targeted HPRT-38285 (SEQ ID NO: 326). T7E1 cleavage assay was performed 72 hours after transfection of both plasmids into the HEK293 cells.

The results are shown in FIG. 3 and FIG. 4. Example 4 demonstrates that rigid helical linker length or rigid AP linker length are functional across a wide range of repeats.

Example 5

Figure 5A:
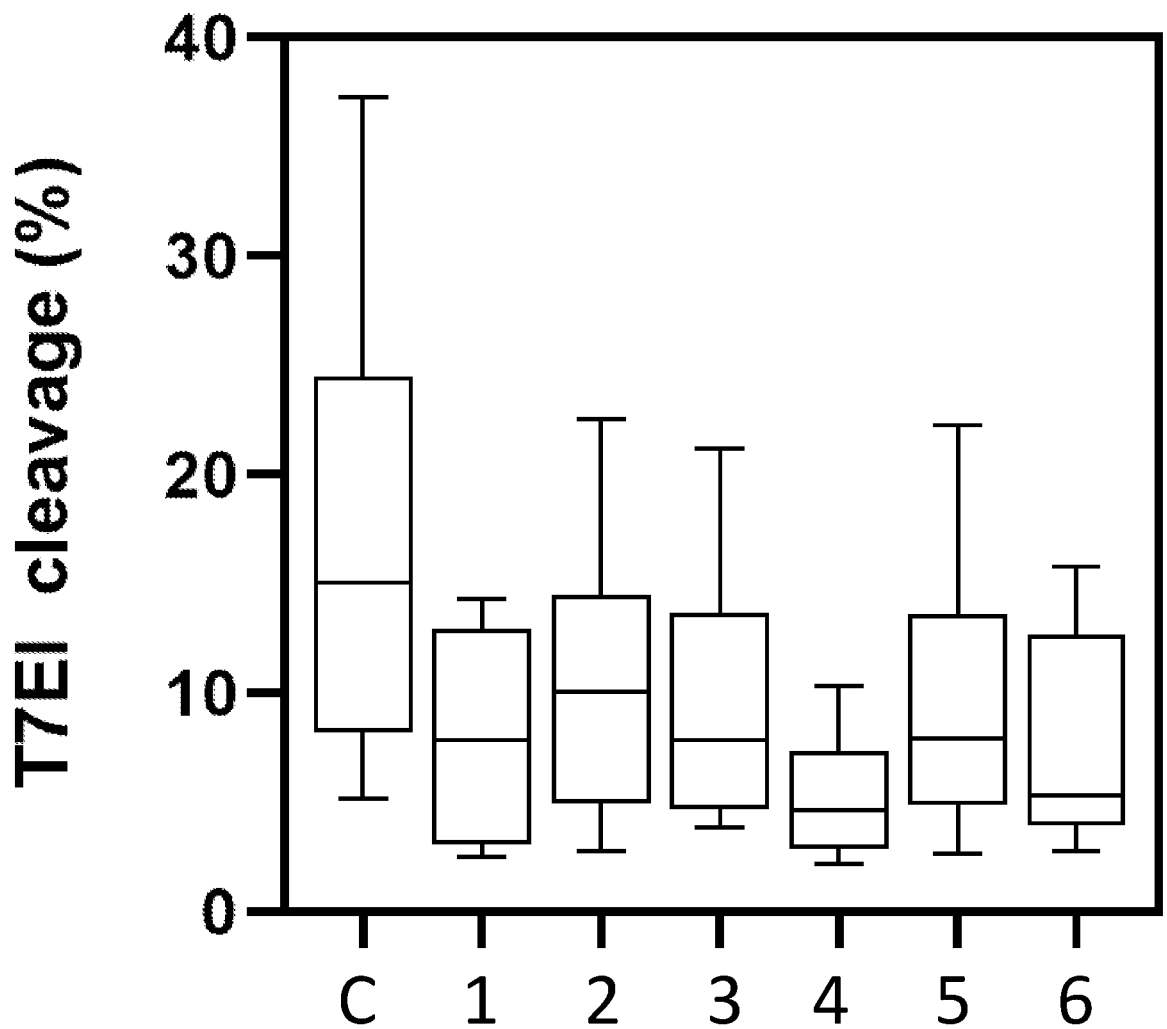
FIG. 5A depicts the editing efficiency of Cas9-GFP linker variants (1, Cas9-GSAGSAAGSGEF-eGFP (SEQ ID NO: 38); 2, Cas9-(AP)$_7$A-eGFP (SEQ ID NO: 49); 3, Cas9-(AP)$_9$A-eGFP (SEQ ID NO: 51); 4, Cas9-GSAGSAAGSGEF-mCherry (SEQ ID NO: 72); 5, Cas9-(AP)$_7$A-mCherry (SEQ ID NO: 83); and 6, Cas9-(AP)$_9$A-mCherry (SEQ ID NO: 85)) compared to untagged Cas9 protein (denoted as "C," SEQ ID NO: 1), delivered at a concentration of 0.0625 micromolar into HEK293 cells. The data are displayed as box and whiskers plots showing the aggregated cleavage efficiency over 12 gRNAs that target distinct loci with HPRT (SEQ ID NOS: 319-330). Cleavage efficiency was measured with T7EI assay 48 hours after transfection.
Figure 5B:
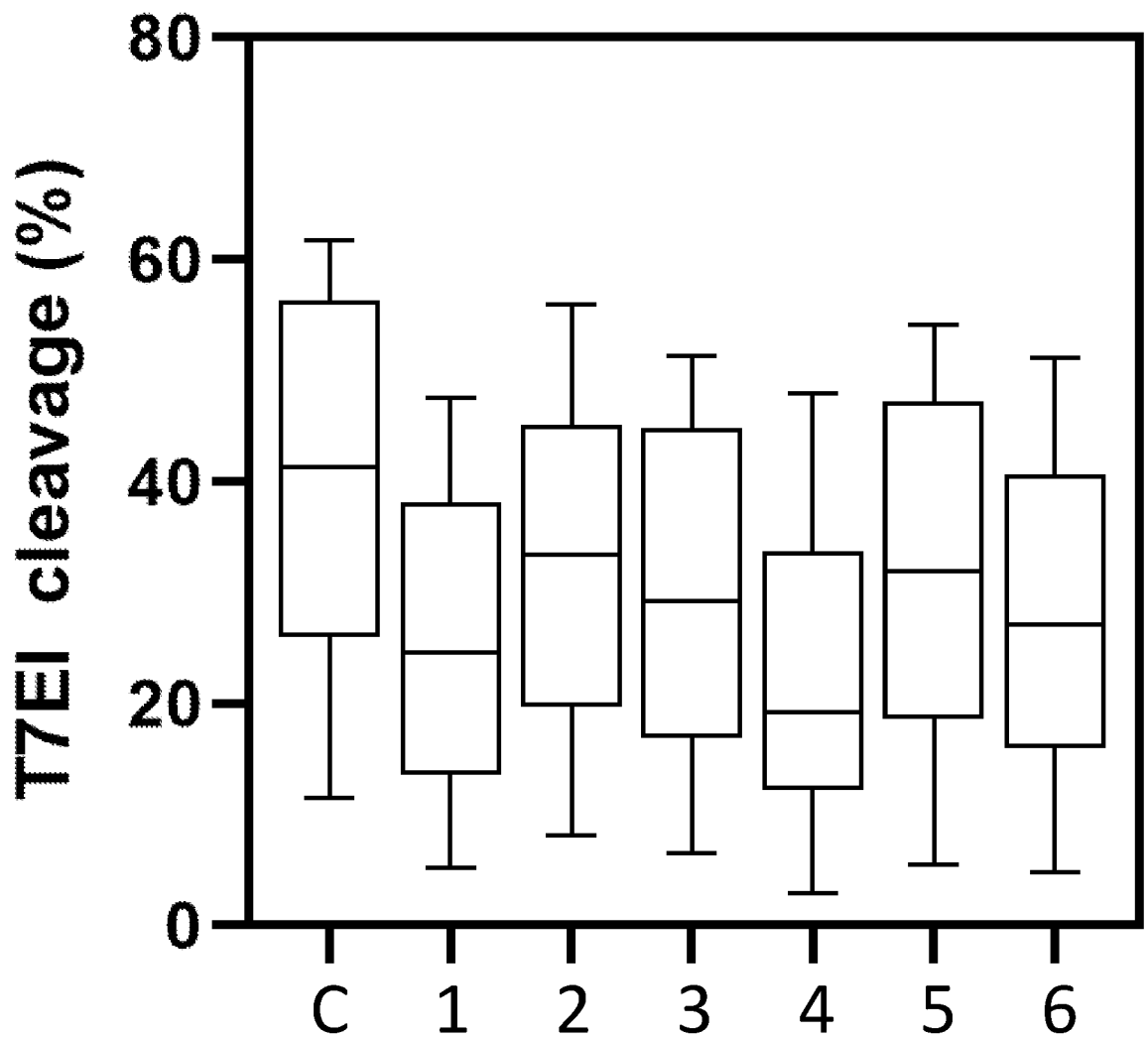
FIG. 5B depicts the editing efficiency of Cas9-GFP linker variants (1, Cas9-GSAGSAAGSGEF-eGFP (SEQ ID NO: 38); 2, Cas9-(AP)$_7$A-eGFP (SEQ ID NO: 49); 3, Cas9-(AP)$_9$A-eGFP (SEQ ID NO: 51); 4, Cas9-GSAGSAAGSGEF-mCherry (SEQ ID NO: 72); 5, Cas9-(AP)$_7$A-mCherry (SEQ ID NO: 83); and 6, Cas9-(AP)$_9$A-mCherry (SEQ ID NO: 85)) compared to untagged Cas9 protein (denoted as "C," SEQ ID NO: 1), delivered at a concentration of 0.25 micromolar into HEK293 cells. The data are displayed as box and whiskers plots showing the aggregated cleavage efficiency over 12 gRNAs that target distinct loci with HPRT (SEQ ID NOS: 319-330). Cleavage efficiency was measured with T7EI assay 48 hours after transfection.
Figure 5C:
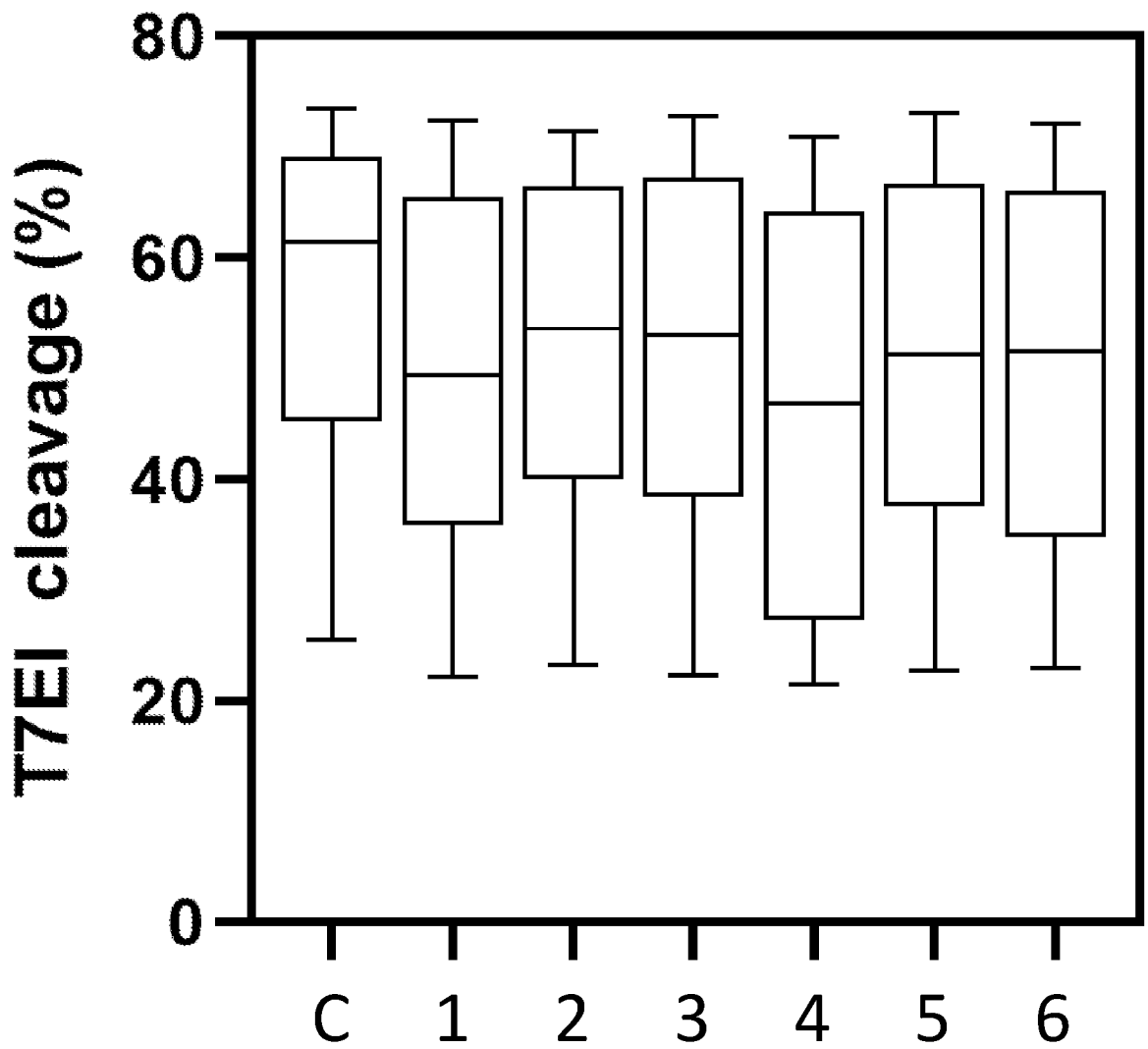
FIG. 5C depicts the editing efficiency of Cas9-GFP linker variants (1, Cas9-GSAGSAAGSGEF-eGFP (SEQ ID NO: 38); 2, Cas9-(AP)$_7$A-eGFP (SEQ ID NO: 49); 3, Cas9-(AP)$_9$A-eGFP (SEQ ID NO: 51); 4, Cas9-GSAGSAAGSGEF-mCherry (SEQ ID NO: 72); 5, Cas9-(AP)$_7$A-mCherry (SEQ ID NO: 83); and 6, Cas9-(AP)$_9$A-mCherry (SEQ ID NO: 85)) compared to untagged Cas9 protein (denoted as "C," SEQ ID NO: 1), delivered at a concentration of 2.0 micromolar into HEK293 cells. The data are displayed as box and whiskers plots showing the aggregated cleavage efficiency over 12 gRNAs that target distinct loci with HPRT (SEQ ID NOS: 319-330). Cleavage efficiency was measured with T7EI assay 48 hours after transfection.

(AP)$_7$A and (AP)$_9$A Linked Cas9-GFP and Cas9-mCherry Editing Activity when Delivered as RNP This example demonstrates that introduction of a (AP)$_7$A linker (SEQ ID NO: 16) or (AP)$_9$A linker (SEQ ID NO: 18) between Cas9 and eGFP results in an improvement in the editing activity of a Cas9-eGFP fusion protein when delivered into human cells as RNP To determine whether rigid linkers increase editing activity for Cas9-GFP when delivered as RNP, Cas9-GFP linker variants containing either the GSA linker, helical rigid linker, or alanine-proline rigid linker were expressed in *E. coli* and purified. RNP complex was formed by incubating Cas9 with ALT-R® sgRNA in PBS in a 1:1.2 ratio for 10 min and then delivered into HEK293 cells at a final RNP concentration of either 0.0625 micromolar, 0.25 micromolar, or 2.0 micromolar, along with 4 micromolar ALT-R® Cas9 Electroporation Enhancer. Editing activity was assayed by T7EI assay as previously described and the results are shown in FIG. 5.

At the 2 micromolar dose of RNP, an increase in editing activity for linker variants containing the (AP)$_7$A linker (linker SEQ ID NO: 16; chimeric Cas9 SEQ ID NO: 49) and (AP)$_9$A linker (linker SEQ ID NO: 18; chimeric Cas9 SEQ ID NO: 51) was observed compared to the flexible GSA linker (linker SEQ ID NO: 6; chimeric Cas9 SEQ ID NO: 38) over the tested sites. The benefit of these linkers was also observed for a second different fluorophore. The second fluorophore tested was mCherry, and the same (AP)$_n$A linkers were used to covalently attach the mCherry to Cas9. As seen in FIG. 5, the same rigid linkers improve Cas9 editing activity.

Example 6

Enrichment of Cas9-eGFP Fusions with Fluorescence Activated Cell Sorting (FACS)

This example demonstrates that the use of an (AP)$_n$A linker between Cas9 and eGFP is compatible with use of Cas9-(AP)$_n$A-eGFP use with FACS to enrich for an edited cell population.

Figure 6:
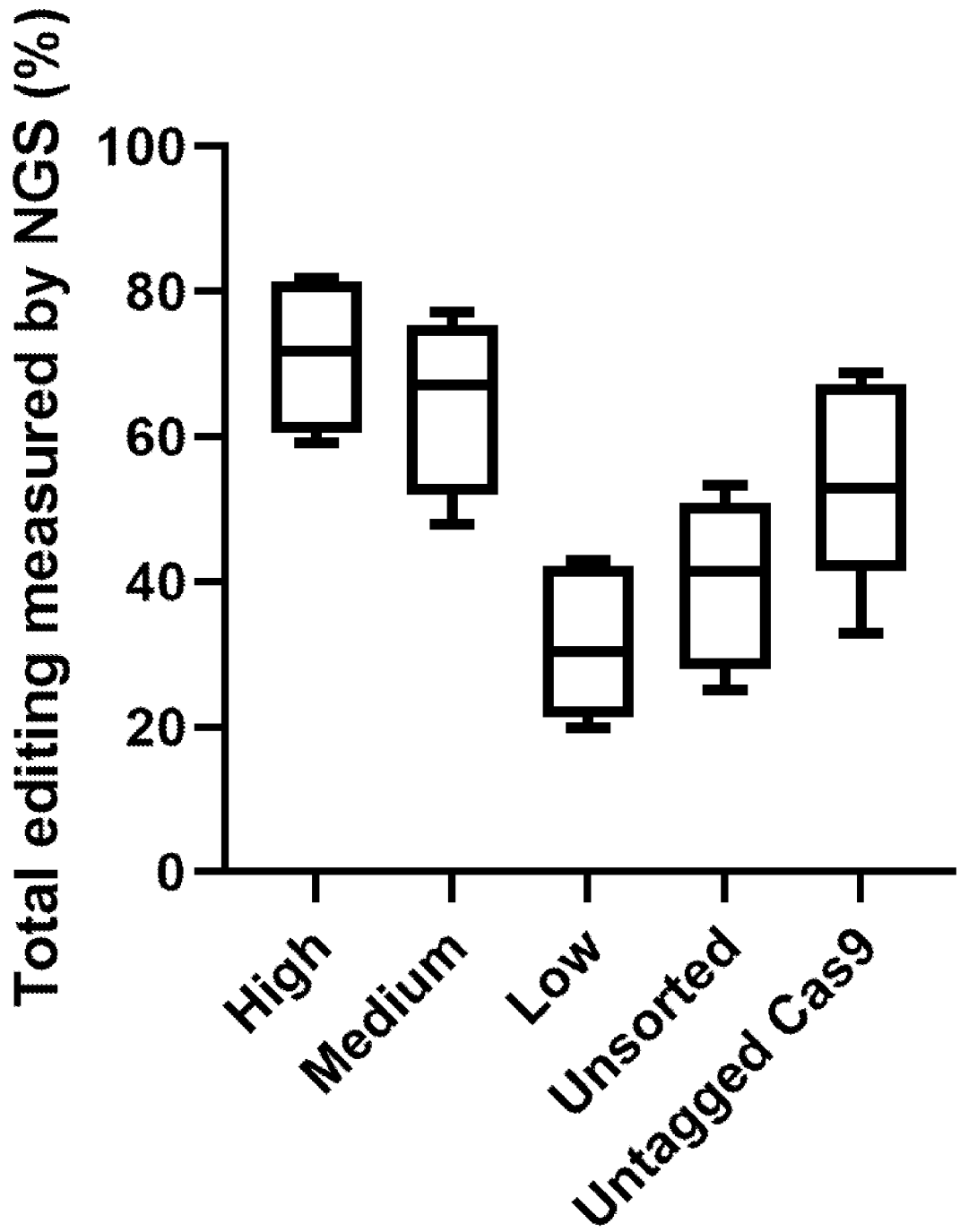
FIG. 6 depicts the effect of FACS selection of GFP signal cells on editing by Cas9-eGFP fusion proteins in HEK293 cells compared to unsorted cells. An RNP comprising chimeric Cas9-(AP)$_7$A-eGFP protein (SEQ ID NO: 49) duplexed with guide RNAs was introduced into HEK293 cells by lipofection at a final concentration of 10 nM. Cells were sorted into three populations based on GFP signal corresponding to high medium and low GFP signal (high GFP signal, the top ~20% of signal; medium GFP signal, the mid ~80-60% of signal, and low GFP signal, the bottom ~60% of signal). Next Generation Sequencing (NGS) of target sites was performed for each population to measure total editing activity percentage 48-72 hours after transfection.

To determine whether Cas9-(AP)nA-eGFP can be used with FACS to enrich for cells with edits, RNP complex was formed as in Example 5 using a chimeric Cas9-(AP)$_7$A-eGFP protein (SEQ ID NO: 49) or wild-type Cas9 (SEQ ID NO: 1) and delivered into cells using Lipofectamine RNAiMAX at 10 nM final concentration in 3 wells of a 6 well dish with 1.2 million cells per well. After ~16 hours, cells were trypsinized, washed with PBS, and resuspended in PBS containing 1% FBS. Cells were filtered through a 70 uM Flowmi Tip Strainer (Bel-Art). Approximately 10% of cells were transferred into a collection tube containing 500 uls of PBS with 1% FBS as the unsorted control. Cells into which Cas9-eGFP was delivered were sorted based on GFP signal using a Becton Dickinson Aria II cell sorter. Cells were sorted into three populations consisting of the cells with the top ~20% of signal, the mid ~80-60% of signal, and the bottom ~60% of signal. Total editing in cells 48-72 hours after delivery was measured by NGS and results are shown in FIG. 6. The highest signal cell populations had significantly higher editing than the unsorted cell population, indicating that Cas9-eGFP fusions fused with rigid linkers is suitable for this application.

Example 7

Evaluation of Chimeric LbCas12a Protein Variants with eGFP Protein

Figure 7:
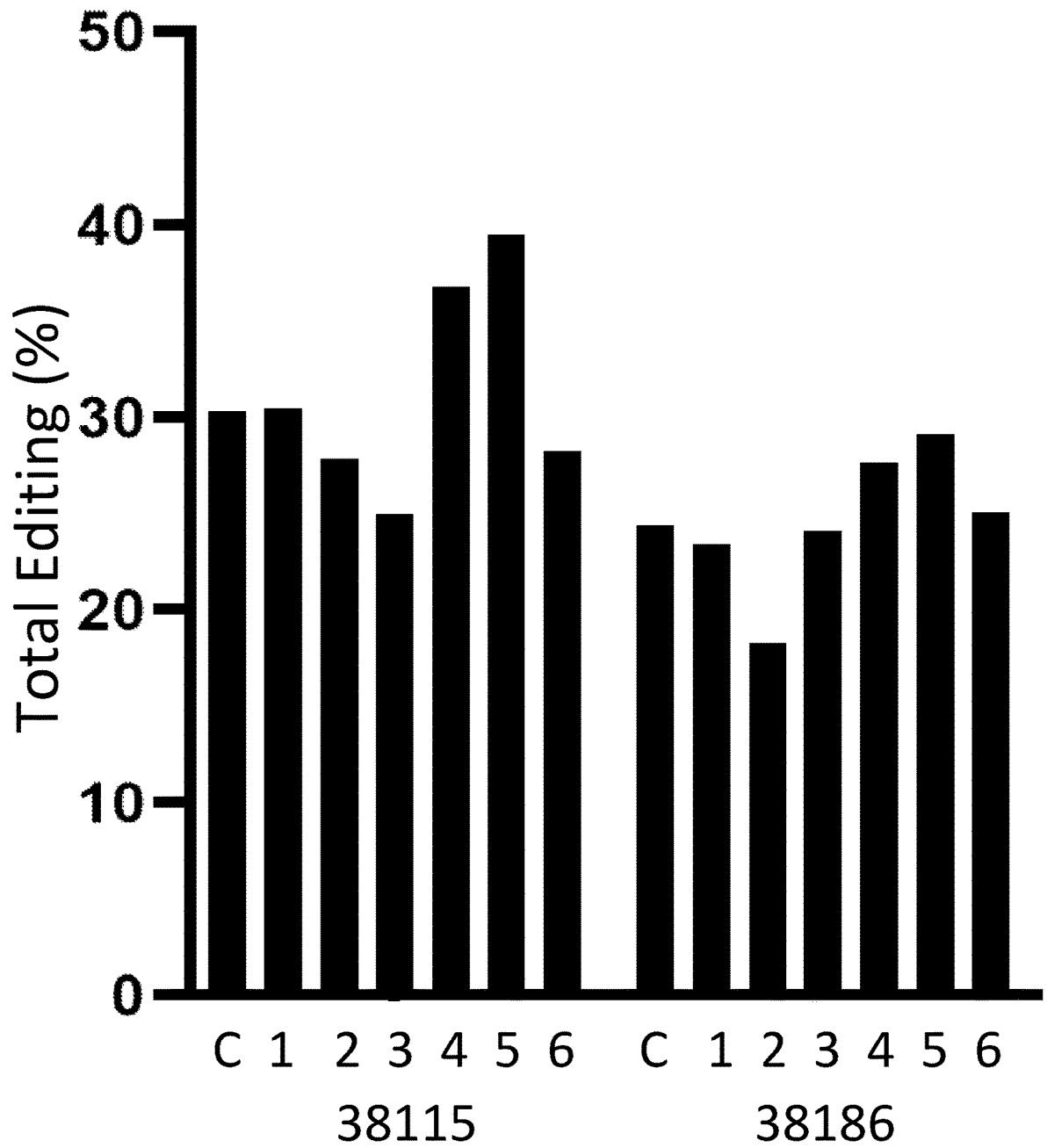
FIG. 7 depicts exemplary results for the editing efficiency of LbCas12a (E795L)-GFP linker variants (1, LbCas12a (E795L)-eGFP (SEQ ID NO: 314); 2, LbCas12a (E795L)-A(EAAAK)$_4$A-eGFP (SEQ ID NO: 244); 3, LbCas12a (E795L)-(GGGS)$_4$-eGFP (SEQ ID NO: 243); 4, LbCas12a (E795L)-(AP)$_7$A-eGFP (SEQ ID NO: 253); 5, LbCas12a (E795L)-(AP)$_9$A-eGFP (SEQ ID NO: 255); and 6, LbCas12a (E795L)-A(EAAAK)$_4$ALEA(EAAAK)$_4$A-eGFP (SEQ ID NO: 245); compared to untagged LbCas12a (E795L) protein (denoted as "C," SEQ ID NO: 310), delivered at a concentration of 50 nM into HEK293 cells, with select ALT-R® LbCas12a crRNAs that target distinct loci with HPRT. Results shown for 38115: Cpf1 HPRT 38115-AS (SEQ ID NO: 333) and 38186: Cpf1 HPRT 38186-S (SEQ ID NO: 334); comparable results were obtained for two additional guide RNAs (Cpf1 HPRT 38330-AS (SEQ ID NO: 335) and Cpf1 HPRT 38486-S (SEQ ID NO: 336)) (data not shown).

To determine whether rigid linkers increase editing efficiency in the context of another RNA guided endonuclease, the LbCas12a protein variant (E795L) (SEQ ID NO: 310) was fused to eGFP (SEQ ID NO: 4) using either no linker (chimeric LbCas12a(E795L)-eGFP protein; SEQ ID NO: 314) or a subset of the linkers listed in Table I was expressed in *E. coli* and purified. RNP complex was formed by incubating untagged or chimeric LbCas12a (E795L) proteins with ALT-R® LbCas12a crRNA (see Table IV) in PBS in a 1:1.2 ratio for 10 min and then delivered into HEK293 cells at a final concentration of 50 nM along with 3 micromolar ALT-R® Cas12a Electroporation Enhancer. Editing 48 hours after delivery was measured by NGS and the results are shown in FIG. 7. An increase in editing activity was observed for linker variants containing the (AP)$_7$A and (AP)$_9$A linkers compared to no linker or the other linkers tested. These are the same linkers that were observed to provide a benefit to editing in the context of chimeric Cas9-GFP proteins.

TABLE IV

Guide RNAs used in combination with LbCas12a protein variant (E795L) chimeras.

| SEQ ID NO: | Protospacer sequence | Guide Name |
|---|---|---|
| 333 | ACACACCCAAGGAAAGACTAT | Cpf1 HPRT 38115-AS |
| 334 | TAATGCCCTGTAGTCTCTCTG | Cpf1 HPRT 38186-S |
| 335 | GGTTAAAGATGGTTAAATGAT | Cpf1 HPRT 38330-AS |
| 336 | TTGTAGGATATGCCCTTGACT | Cpf1 HPRT 38486-S |

Example 8

Exemplary Sequences of Cas Proteins and Nucleic Acids

The wild-type Cas9 protein amino acid sequence is presented as SEQ ID NO: 1. Polynucleotides codon-optimized for expression in *E. coli* and human cells are presented in SEQ ID NOs.: 337 and 338, respectively. Exemplary variants of Cas9 protein, the polynucleotides encoding them, as well as exemplary guide RNAs are disclosed in U.S. patent application Ser. Nos. 15/729,491 and 15/964,041, filed Oct. 10, 2017 and Apr. 26, 2018, respectively, the contents of which are incorporated by reference herein.

(Cas9 protein amino acid sequence)

SEQ ID NO: 1

MDKKYSIGLDIGTNSVGWAVITDEYKVPSKKFKVLGNTDRHSIKKNLIGALLFDSGETAEATRLKRTARRRYTRRKN
RICYLQEIFSNEMAKVDDSFFHRLEESFLVEEDKKHERHPIFGNIVDEVAYHEKYPTIYHLRKKLVDSTDKADLRLI
YLALAHMIKFRGHFLIEGDLNPDNSDVDKLFIQLVQTYNQLFEENPINASGVDAKAILSARLSKSRRLENLIAQLPG
EKKNGLFGNLIALSLGLTPNEKSNFDLAEDAKLQLSKDTYDDDLDNLLAQIGDQYADLFLAAKNLSDAILLSDILRV
NTEITKAPLSASMIKRYDEHHQDLTLLKALVRQQLPEKYKEIFFDQSKNGYAGYIDGGASQEEFYKFIKPILEKMDG
TEELLVKLNREDLLRKQRTFDNGSIPHQIHLGELHAILRRQEDFYPFLKDNREKIEKILTFRIPYYVGPLARGNSRF
AWMTRKSEETITPWNFEEVVDKGASAQSFIERMTNEDKNLPNEKVLPKHSLLYEYFTVYNELTKVKYVTEGMRKPAF
LSGEQKKAIVDLLFKTNRKVTVKQLKEDYFKKIECFDSVEISGVEDRFNASLGTYHDLLKIIKDKDFLDNEENEDIL
EDIVLTLTLFEDREMIEERLKTYAHLFDDKVMKQLKRRRYTGWGRLSRKLINGIRDKQSGKTILDFLKSDGFANRNF
MQLIHDDSLTFKEDIQKAQVSGQGDSLHEHIANLAGSPAIKKGILQTVKVVDELVKVMGRHKPENIVIEMARENQTT
QKGQKNSRERMKRIEEGIKELGSQILKEHPVENTQLQNEKLYLYYLQNGRDMYVDQELDINRLSDYDVDHIVPQSFL
KDDSIDNKVLTRSDKNRGKSDNVPSEEVVKKMKNYWRQLLNAKLITQRKFDNLTKAERGGLSELDKAGFIKRQLVET
RQITKHVAQILDSRMNTKYDENDKLIREVKVITLKSKLVSDERKDFQFYKVREINNYHHAHDAYLNAVVGTALIKKY
PKLESEFVYGDYKVYDVRKMIAKSEQEIGKATAKYFFYSNIMNFFKTEITLANGEIRKRPLIETNGETGEIVWDKGR
DFATVRKVLSMPQVNIVKKTEVQTGGFSKESILPKRNSDKLIARKKDWDPKKYGGFDSPTVAYSVLVVAKVEKGKSK
KLKSVKELLGITIMERSSFEKNPIDFLEAKGYKEVKKDLIIKLPKYSLFELENGRKRMLASAGELQKGNELALPSKY
VNFLYLASHYEKLKGSPEDNEQKQLFVEQHKHYLDEIIEQISEFSKRVILADANLDKVLSAYNKHRDKPIREQAENI
IHLFTLTNLGAPAAFKYFDTTIDRKRYTSTKEVLDATLIHQSITGLYETRIDLSQLGGD (Cas9 DNA sequence, codon-optimized for *E. coli*)

SEQ ID NO: 337

ATGGGCAGCAGCGCCCCAAAGAAGAAGCGGAAGGTCGGTATCCACGGAGTCCCAGCAGCCATGGACAAAAAGTACTC
TATTGGCCTGGATATCGGGACCAACAGCGTCGGGTGGCTGTTATCACCGACGAGTATAAAGTACCTTCGAAAAAGT
TCAAAGTGCTGGGCAACACCGATCGCCATTCAATCAAAAAGAACTTGATTGGTGCGCTGTTGTTTGACTCCGGGGAA
ACCGCCGAGGCGACTCGCCTTAAACGTACAGCACGTCGCCGGTACACTCGGCGTAAGAATCGCATTTGCTATTTGCA
GGAAATCTTTAGCAACGAGATGGCAAAAGTCGATGACTCGTTTTTCCACCGCCTCGAGGAAAGCTTTCTGGTGGAGG
AAGACAAAAAGCATGAGCGTCACCCGATCTTCGGCAACATTGTCGATGAAGTAGCGTATCATGAAAAATACCCAACC
ATTTACCACTTACGCAAAAAGCTGGTGGACAGCACTGACAAAGCTGATTTGCGCCTTATCTATTTAGCCCTGGCACA
TATGATTAAGTTTCGTGGTCACTTCCTGATCGAAGGAGACTTAAATCCCGACAACAGTGATGTTGATAAATTGTTTA
TTCAGCTTGTCCAAACTTACAATCAACTGTTCGAGGAAAACCCGATCAATGCCTCCGGTGTGGATGCAAAAGCCATT
TTAAGTGCACGCCTTAGCAAGTCCCGTCGCTTAGAAAACCTTATCGCGCAGCTGCCCGGCGAGAAAAAGAATGGTTT
GTTTGGGAACCTTATTGCCTTGAGCTTAGGCCTCACCCCGAATTTCAAAAGTAATTTCGATCTTGCAGAAGACGCCA
AATTACAACTGTCGAAGGATACTTATGATGACGATCTCGATAATCTGTTAGCGCAGATTGGTGACCAATACGCCGAT
CTTTTTCTGGCGGCTAAAAATCTGAGCGACGCCATCTTGCTTTCGGATATTCTCCGCGTTAACACCGAAATCACGAA
AGCGCCTCTTAGTGCCAGCATGATTAAACGTTATGATGAACACCACCAGGACCTGACCTTACTCAAAGCGTTGGTTC
GCCAGCAACTGCCAGAGAAGTACAAAGAAATCTTCTTTGATCAGTCAAAGAATGGTTATGCCGGCTATATTGACGGG
GGTGCAAGCCAAGAGGAATTCTACAAATTTATCAAGCCTATTCTGGAGAAAATGGATGGCACCGAAGAGTTATTGGT
GAAGCTTAACCGTGAAGACCTCCTGCGGAAACAGCGCACATTCGATAATGGTTCGATCCCACACCAAATCCATTTGG
GGGAGTTACACGCTATTTTGCGTCGCCAGGAAGACTTTTACCCTTTCCTGAAGGATAACGGGAGAAAATTGAGAAG
ATCCTTACCTTTCGTATTCCGTATTACGTAGGCCCCTTAGCACGGGGTAATAGCCGTTTCGCGTGGATGACACGGAA
GTCGGAAGAGACGATCACCCCGTGGAACTTCGAAGAGGTAGTCGACAAGGGCGCATCAGCGCAGTCTTTTATTGAAC
GTATGACGAATTTCGATAAAAACTTGCCCAATGAGAAGGTGCTTCCGAAACATTCCTTGTTATATGAATATTTTACA

-continued

```
GTTTACAACGAGCTGACCAAGGTTAAATACGTGACGGAAGGAATGCGCAAGCCCGCTTTTCTTAGCGGTGAGCAAAA
AAAGGCGATCGTCGACCTGTTATTCAAAACGAATCGTAAGGTGACTGTAAAGCAACTCAAAGAAGATTACTTCAAAA
AGATTGAGTGCTTCGACAGCGTCGAAATCTCTGGGGTAGAGGATCGGTTTAACGCAAGTTTAGGTACCTACCATGAC
CTGCTTAAAATCATTAAGGATAAAGACTTCTTAGATAATGAAGAACGAAGATATTCTCGAGGACATCGTCTTGAC
GTTAACCTTATTTGAGGATCGTGAAATGATTGAGGAACGCCTCAAAACTTATGCCCACCTGTTCGACGATAAGGTGA
TGAAGCAGCTGAAACGTCGGCGCTACACAGGATGGGGCCGCTTGAGTCGCAAACTTATTAACGGAATCCGTGACAAG
CAATCCGGCAAAACGATTCTGGATTTCTTGAAGTCGGACGGATTTGCTAATCGCAACTTCATGCAGTTGATCCATGA
TGACTCCCTGACTTTTAAAGAGGATATTCAAAAGGCGCAGGTTAGTGGTCAAGGCGACAGCTTACACGAACACATCG
CAAATTTGGCTGGTTCGCCGGCCATTAAAAAGGGGATCCTCCAGACCGTGAAAGTTGTAGATGAGCTTGTTAAGGTC
ATGGGTCGTCATAAGCCCGAAAACATCGTGATTGAAATGGCGCGGGAGAATCAAACGACCCAGAAAGGACAAAAGAA
TAGCCGTGAACGGATGAAGCGGATCGAGGAAGGCATTAAAGAGCTGGGGTCTCAAATCTTGAAGGAACACCCTGTGG
AGAACACTCAGCTCCAAAATGAAAAACTTTACCTGTACTATTTGCAGAACGGACGCGATATGTACGTGGACCAAGAG
TTGGATATTAATCGGCTGAGTGACTACGACGTTGATCATATCGTCCCGCAGAGCTTCCTCAAAGACGATTCTATTGA
CAATAAGGTACTGACGCGCTCTGATAAAAACCGTGGTAAGTCGGACAACGTGCCCTCCGAAGAGGTTGTGAAAAAGA
TGAAAAATTATTGGCGCCAGCTTTTAAACGCGAAGCTGATCACACAACGTAAATTCGATAATTTGACCAAGGCTGAA
CGGGGTGGCCTGAGCGAGTTAGATAAGGCAGGATTTATTAAACGCCAGTTAGTGGAGACTCGTCAAATCACCAAACA
TGTCGCGCAGATTTTGGACAGCCGGATGAACACCAAGTACGATGAAAATGACAAACTGATCCGTGAGGTGAAAGTCA
TTACTCTGAAGTCCAAATTAGTTAGTGATTTCCGGAAGGACTTTCAATTCTACAAAGTCCGTGAAATTAATAACTAT
CATCACGCACATGACGCGTACCTGAATGCAGTGGTTGGGACCGCCCTTATCAAGAAATATCCTAAGCTGGAGTCGGA
GTTTGTCTATGGCGACTATAAGGTATACGATGTTCGCAAAATGATTGCGAAATCTGAGCAGGAGATCGGTAAGGCAA
CCGCAAAATATTTCTTTTACTCAAACATTATGAATTTCTTTAAGACAGAAATCACTCTGGCCAACGGGGAGATTCGC
AAACGTCCGTTGATCGAAACAAACGGCGAGACTGGCGAAATTGTTTGGGACAAAGGGCGTGATTTCGCGACGGTGCG
CAAGGTACTGAGCATGCCTCAAGTCAATATTGTTAAGAAAACCGAAGTGCAGACGGGCGGGTTTTCCAAGGAAAGCA
TCTTACCCAAACGTAATTCAGATAAACTTATTGCACGCAAAAAGGACTGGGATCCGAAAAAGTATGGAGGCTTCGAC
AGTCCAACCGTAGCCTACTCTGTTCTCGTTGTAGCGAAAGTAGAAAAGGGTAAATCCAAGAAACTGAAATCTGTCAA
GGAGTTGCTTGGAATCACCATTATGGAGCGTAGCTCCTTCGAGAAGAACCCGATTGACTTTCTGGAAGCCAAAGGAT
ATAAAGAGGTCAAGAAAGATCTTATCATTAAGCTGCCTAAGTATTCACTCTTCGAGCTGGAAAATGGTCGTAAACGC
ATGCTCGCTTCTGCCGGCGAGTTGCAGAAGGGCAATGAATTAGCACTTCCATCAAAGTACGTTAACTTCCTGTATTT
GGCCAGCCATTACGAGAAACTGAAGGGGTCTCCAGAGGACAACGAACAGAAACAATTATTTGTAGAGCAGCACAAGC
ATTATCTTGATGAAATCATTGAGCAAATTTCCGAATTCAGTAAACGCGTAATCCTGGCCGATGCAAACCTCGACAAG
GTGCTGAGCGCTTACAATAAGCATCGCGACAAACCTATCCGTGAGCAGGCTGAAAATATCATTCACCTGTTCACATT
AACGAACCTGGGCGCTCCGGCCGCTTTTAAATATTTCGACACGACAATCGACCGTAAGCGCTATACCAGTACGAAAG
AAGTGTTGGATGCGACCCTTATTCACCAGTCAATTACAGGATTATATGAGACCCGTATCGACCTTAGCCAATTAGGT
GGGGATGCGGCCCCGAAGAAAAACGCAAAGTGGATCCGAAGAAAAACGCAAAGTGGCGGCCGCACTCGAGCACCA
CCACCACCACCACTGA
```

(Cas9 DNA sequence, codon-optimized for *H. sapiens*)

SEQ ID NO: 338
```
ATGGGCAAGCCCATCCCTAACCCCCTGTTGGGGCTGGACAGCACCGCTCCCAAAAAGAAAAGGAAGGTGGGCATTCA
CGGCGTGCCTGCGGCCGACAAAAAGTACAGCATCGGCCTTGATATCGGCACCAATAGCGTGGGCTGGGCCGTTATCA
CAGACGAATACAAGGTACCCAGCAAGAAGTTCAAGGTGCTGGGGAATACAGACAGGCACTCTATCAAGAAAAACCTT
ATCGGGGCTCTGCTGTTTGACTCAGGCGAGACCGCCGAGGCCACCAGGTTGAAGAGGACCGCAAGGCGAAGGTACAC
```

-continued

```
CCGGAGGAAGAACAGGATCTGCTATCTGCAGGAGATCTTCAGCAACGAGATGGCCAAGGTGGACGACAGCTTCTTCC

ACAGGCTGGAGGAGAGCTTCCTTGTCGAGGAGGATAAGAAGCACGAACGACACCCCATCTTCGGCAACATAGTCGAC

GAGGTCGCTTATCACGAGAAGTACCCCACCATCTACCACCTGCGAAAGAAATTGGTGGATAGCACCGATAAAGCCGA

CTTGCGACTTATCTACTTGGCTCTGGCGCACATGATTAAGTTCAGGGGCCACTTCCTGATCGAGGGCGACCTTAACC

CCGACAACAGTGACGTAGACAAATTGTTCATCCAGCTTGTACAGACCTATAACCAGCTGTTCGAGGAAAACCCTATT

AACGCCAGCGGGGTGGATGCGAAGGCCATACTTAGCGCCAGGCTGAGCAAAAGCAGGCGCTTGGAGAACCTGATAGC

CCAGCTGCCCGGTGAAAAGAAGAACGGCCTCTTCGGTAATCTGATTGCCCTGAGCCTGGGCCTGACCCCCAACTTCA

AGAGCAACTTCGACCTGGCAGAAGATGCCAAGCTGCAGTTGAGTAAGGACACCTATGACGACGACTTGGACAATCTG

CTCGCCCAAATCGGCGACCAGTACGCTGACCTGTTCCTCGCCGCCAAGAACCTTTCTGACGCAATCCTGCTTAGCGA

TATCCTTAGGGTGAACACAGAGATCACCAAGGCCCCCCTGAGCGCCAGCATGATCAAGAGGTACGACGAGCACCATC

AGGACCTGACCCTTCTGAAGGCCCTGGTGAGGCAGCAACTGCCCGAGAAGTACAAGGAGATCTTTTTCGACCAGAGC

AAGAACGGCTACGCCGGCTACATCGACGGCGGAGCCAGCCAAGAGGAGTTCTACAAGTTCATCAAGCCCATCCTGGA

GAAGATGGATGGCACCGAGGAGCTGCTGGTGAAGCTGAACAGGGAAGATTTGCTCCGGAAGCAGAGGACCTTTGACA

ACGGTAGCATCCCCCACCAGATCCACCTGGGCGAGCTGCACGCAATACTGAGGCGACAGGAGGATTTCTACCCCTTC

CTCAAGGACAATAGGGAGAAAATCGAAAAGATTCTGACCTTCAGGATCCCCTACTACGTGGGCCCTCTTGCCAGGGG

CAACAGCCGATTCGCTTGGATGACAAGAAAGAGCGAGGAGACCATCACCCCCTGGAACTTCGAGGAAGTGGTGGACA

AAGGAGCAAGCGCGCAGTCTTTCATCGAACGGATGACCAATTTCGACAAAAACCTGCCTAACGAGAAGGTGCTGCCC

AAGCACAGCCTGCTTTACGAGTACTTCACCGTGTACAACGAGCTCACCAAGGTGAAATATGTGACCGAGGGCATGCG

AAAACCCGCTTTCCTGAGCGGCGAGCAGAAGAAGGCCATCGTGGACCTGCTGTTCAAGACCAACAGGAAGGTGACCG

TGAAGCAGCTGAAGGAGGACTACTTCAAGAAGATCGAGTGCTTTGATAGCGTGGAAATAAGCGGCGTGGAGGACAGG

TTCAACGCCAGCCTGGGCACCTACCACGACTTGTTGAAGATAATCAAAGACAAGGATTTCCTGGATAATGAGGAGAA

CGAGGATATACTCGAGGACATCGTGCTGACTTTGACCCTGTTTGAGGACCGAGAGATGATTGAAGAAAGGCTCAAAA

CCTACGCCCACCTGTTCGACGACAAAGTGATGAAACAACTGAAGAGACGAAGATACACCGGCTGGGGCAGACTGTCC

AGGAAGCTCATCAACGGCATTAGGGACAAGCAGAGCGGCAAGACCATCCTGGATTTCCTGAAGTCCGACGGCTTCGC

CAACCGAAACTTCATGCAGCTGATTCACGATGACAGCTTGACCTTCAAGGAGGACATCCAGAAGGCCCAGGTTAGCG

GCCAGGGCGACTCCCTGCACGAACATATTGCAAACCTGGCAGGCTCCCCTGCGATCAAGAAGGGCATACTGCAGACC

GTTAAGGTTGTGGACGAATTGGTCAAGGTCATGGGCAGGCACAAGCCCGAAAACATAGTTATAGAGATGGCCAGAGA

GAACCAGACCACCCAAAAGGGCCAGAAGAACAGCCGGGAGCGCATGAAAAGGATCGAGGAGGGTATCAAGGAACTCG

GAAGCCAGATCCTCAAAGAGCACCCCGTGGAGAATACCCAGCTCCAGAACGAGAAGCTGTACCTGTACTACCTGCAG

AACGGCAGGGACATGTACGTTGACCAGGAGTTGGACATCAACAGGCTTTCAGACTATGACGTGGATCACATAGTGCC

CCAGAGCTTTCTTAAAGACGATAGCATCGACAACAAGGTCCTGACCCGCTCCGACAAAAACAGGGGCAAAAGCGACA

ACGTGCCAAGCGAAGAGGTGGTTAAAAAGATGAAGAACTACTGGAGGCAACTGCTCAACGCGAAATTGATCACCCAG

AGAAAGTTCGATAACCTGACCAAGGCCGAGAGGGGCGGACTCTCCGAACTTGACAAAGCGGGCTTCATAAAGAGGCA

GCTGGTCGAGACCCGACAGATCACGAAGCACGTGGCCCAAATCCTCGACAGCAGAATGAATACCAAGTACGATGAGA

ATGACAAACTCATCAGGGAAGTGAAAGTGATTACCCTGAAGAGCAAGTTGGTGTCCGACTTTCGCAAAGATTTCCAG

TTCTACAAGGTGAGGGAGATCAACAACTACCACCATGCCCACGACGCATACCTGAACGCCGTGGTCGGCACCGCCCT

GATTAAGAAGTATCCAAAGCTGGAGTCCGAATTTGTCTACGGCGACTACAAAGTTTACGATGTGAGGAAGATGATCG

CTAAGAGCGAACAGGAGATCGGCAAGGCCACCGCTAAGTATTTCTTCTACAGCAACATCATGAACTTTTTCAAGACC

GAGATCACACTTGCCAACGGCGAAATCAGGAAGAGGCCGCTTATCGAGACCAACGGTGAGACCGGCGAGATCGTGTG

GGACAAGGGCAGGGACTTCGCCACCGTGAGGAAAGTCCTGAGCATGCCCCAGGTGAATATTGTGAAAAAACTGAGG

TGCAGACAGGCGGCTTTAGCAAGGAATCCATCCTGCCCAAGAGGAACAGCGACAAGCTGATCGCCCGGAAGAAGGAC
```

```
TGGGACCCTAAGAAGTATGGAGGCTTCGACAGCCCCACCGTAGCCTACAGCGTGCTGGTGGTCGCGAAGGTAGAGAA

GGGGAAGAGCAAGAAACTGAAGAGCGTGAAGGAGCTGCTCGGCATAACCATCATGGAGAGGTCCAGCTTTGAGAAGA

ACCCCATTGACTTTTTGGAAGCCAAGGGCTACAAAGAGGTCAAAAAGGACCTGATCATCAAACTCCCCAAGTACTCC

CTGTTTGAATTGGAGAACGGCAGAAAGAGGATGCTGGCGAGCGCTGGGGAACTGCAAAAGGGCAACGAACTGGCGCT

GCCCAGCAAGTACGTGAATTTTCTGTACCTGGCGTCCCACTACGAAAAGCTGAAAGGCAGCCCCGAGGACAACGAGC

AGAAGCAGCTGTTCGTGGAGCAGCACAAGCATTACCTGGACGAGATAATCGAGCAAATCAGCGAGTTCAGCAAGAGG

GTGATTCTGGCCGACGCGAACCTGGATAAGGTCCTCAGCGCCTACAACAAGCACCGAGACAAACCCATCAGGGAGCA

GGCCGAGAATATCATACACCTGTTCACCCTGACAAATCTGGGCGCACCTGCGGCATTCAAATACTTCGATACCACCA

TCGACAGGAAAAGGTACACTAGCACTAAGGAGGTGCTGGATGCCACCTTGATCCACCAGTCCATTACCGGCCTGTAT

GAGACCAGGATCGACCTGAGCCAGCTTGGAGGCGACTCTAGGGCGGACCCAAAAAAGAAAAGGAAGGTGGAATTCCA

CCACACTGGACTAGTGGATCCGAGCTCGGTACCAAGCTTAAGTTTAAACCGCTGA
```

20

The wild-type AsCas12a protein amino acid sequence is presented as SEQ ID NO: 2. Polynucleotides codon-optimized for expression in E. coli and human cells are presented as SEQ ID NOs.: 339 and 340, respectively. Exemplary variants of AsCas12a protein, the polynucleotides encoding them, as well as exemplary guide RNAs are disclosed in U.S. patent application Ser. No. 16/536,256, filed Aug. 8, 2019, the contents of which are incorporated by reference herein.

```
(AsCas12a protein amino acid sequence)
                                                          SEQ ID NO: 2
MTQFEGFTNLYQVSKTLRFELIPQGKTLKHIQEQGFIEEDKARNDHYKELKPIIDRIYKTYADQCLQLVQLDWENLS

AAIDSYRKEKTEETRNALIEEQATYRNAIHDYFIGRTDNLTDAINKRHAEIYKGLFKAELFNGKVLKQLGTVTTTEH

ENALLRSFDKETTYFSGEYENRKNVESAEDISTAIPHRIVQDNFPKFKENCHIFTRLITAVPSLREHFENVKKAIGI

FVSTSIEEVFSFPFYNQLLTQTQIDLYNQLLGGISREAGTEKIKGLNEVLNLAIQKNDETAHIIASLPHRFIPLFKQ

ILSDRNTLSFILEEFKSDEEVIQSFCKYKTLLRNENVLETAEALFNELNSIDLTHIFISHKKLETISSALCDHWDTL

RNALYERRISELTGKITKSAKEKVQRSLKHEDINLQEIISAAGKELSEAFKQKTSEILSHAHAALDQPLPTTLKKQE

EKEILKSQLDSLLGLYHLLDWFAVDESNEVDPEFSARLTGIKLEMEPSLSFYNKARNYATKKPYSVEKFKLNFQMPT

LASGWDVNKEKNNGAILFVKNGLYYLGIMPKQKGRYKALSFEPTEKTSEGFDKMYYDYFPDAAKMIPKCSTQLKAVT

AHFQTHTTPILLSNNFIEPLEITKEIYDLNNPEKEPKKFQTAYAKKTGDQKGYREALCKWIDETRDELSKYTKTTSI

DLSSLRPSSQYKDLGEYYAELNPLLYHISFQRIAEKEIMDAVETGKLYLFQIYNKDFAKGHHGKPNLHTLYWTGLFS

PENLAKTSIKLNGQAELFYRPKSRMKRMAHRLGEKMLNKKLKDQKTPIPDTLYQELYDYVNHRLSHDLSDEARALLP

NVITKEVSHEIIKDRRFTSDKEFFHVPITLNYQAANSPSKFNQRVNAYLKEHPETPIIGIDRGERNLIYITVIDSTG

KILEQRSLNTIQQFDYQKKLDNREKERVAARQAWSVVGTIKDLKQGYLSQVIHEIVDLMIHYQAVVVLENLNEGEKS

KRTGIAEKAVYQQFEKMLIDKLNCLVLKDYPAEKVGGVLNPYQLTDQFTSFAKMGTQSGELFYVPAPYTSKIDPLTG

FVDPFVWKTIKNHESRKHFLEGFDFLHYDVKTGDFILHFKMNRNLSFQRGLPGEMPAWDIVFEKNETQFDAKGTPFI

AGKRIVPVIENHRFTGRYRDLYPANELIALLEEKGIVERDGSNILPKLLENDDSHAIDTMVALIRSVLQMRNSNAAT

GEDYINSPVRDLNGVCEDSREQNPEWPMDADANGAYHIALKGQLLLNHLKESKDLKLQNGISNQDWLAYIQELRN (AsCas12a DNA sequence, codon-optimized for E. coli)
                                                          SEQ ID NO: 339
ATGACCCAGTTTGAAGGTTTCACCAATCTGTATCAGGTTAGCAAAACCCTGCGTTTTGAACTGATTCCGCAGGGTAA

AACCCTGAAACATATTCAAGAACAGGGCTTCATCGAAGAGGATAAAGCACGTAACGATCACTACAAAGAACTGAAAC

CGATTATCGACCGCATCTATAAAACCTATGCAGATCAGTGTCTGCAGCTGGTTCAGCTGGATTGGGAAAATCTGAGC

GCAGCAATTGATAGTTATCGCAAAGAAAAAACCGAAGAAACCCGTAATGCACTGATTGAAGAACAGGCAACCTATCG

TAATGCCATCCATGATTATTTCATTGGTCGTACCGATAATCTGACCGATGCAATTAACAAACGTCACGCCGAAATCT

ATAAAGGCCTGTTTAAAGCCGAACTGTTTAATGGCAAAGTTCTGAAACAGCTGGGCACCGTTACCACCACCGAACAT
```

-continued

```
GAAAATGCACTGCTGCGTAGCTTTGATAAATTCACCACCTATTTCAGCGGCTTTTATGAGAATCGCAAAAACGTGTT

TAGCGCAGAAGATATTAGCACCGCAATTCCGCATCGTATTGTGCAGGATAATTTCCCGAAATTCAAAGAGAACTGCC

ACATTTTTACCCGTCTGATTACCGCAGTTCCGAGCCTGCGTGAACATTTTGAAAACGTTAAAAAAGCCATCGGCATC

TTTGTTAGCACCAGCATTGAAGAAGTTTTTAGCTTCCCGTTTTACAATCAGCTGCTGACCCAGACCCAGATTGATCT

GTATAACCAACTGCTGGGTGGTATTAGCCGTGAAGCAGGCACCGAAAAAATCAAAGGTCTGAATGAAGTGCTGAATC

TGGCCATTCAGAAAAATGATGAAACCGCACATATTATTGCAAGCCTGCCGCATCGTTTTATTCCGCTGTTCAAACAA

ATTCTGAGCGATCGTAATACCCTGAGCTTTATTCTGGAAGAATTCAAATCCGATGAAGAGGTGATTCAGAGCTTTTG

CAAATACAAAACGCTGCTGCGCAATGAAAATGTTCTGGAAACTGCCGAAGCACTGTTTAACGAACTGAATAGCATTG

ATCTGACCCACATCTTTATCAGCCACAAAAAACTGGAAACCATTTCAAGCGCACTGTGTGATCATTGGGATACCCTG

CGTAATGCCCTGTATGAACGTCGTATTAGCGAACTGACCGGTAAAATTACCAAAAGCGCGAAAGAAAAAGTTCAGCG

CAGTCTGAAACATGAGGATATTAATCTGCAAGAGATTATTAGCGCAGCCGGTAAAGAACTGTCAGAAGCATTTAAAC

AGAAAACCAGCGAAATTCTGTCACATGCACATGCAGCACTGGATCAGCCGCTGCCGACCACCCTGAAAAAACAAGAA

GAAAAAGAAATCCTGAAAAGCCAGCTGGATAGCCTGCTGGGTCTGTATCATCTGCTGGACTGGTTTGCAGTTGATGA

AAGCAATGAAGTTGATCCGGAATTTAGCGCACGTCTGACCGGCATTAAACTGGAAATGGAACCGAGCCTGAGCTTTT

ATAACAAAGCCCGTAATTATGCCACCAAAAAACCGTATAGCGTCGAAAAATTCAAACTGAACTTTCAGATGCCGACC

CTGGCAAGCGGTTGGGATGTTAATAAAGAAAAAAACAACGGTGCCATCCTGTTCGTGAAAAATGGCCTGTATTATCT

GGGTATTATGCCGAAACAGAAAGGTCGTTATAAAGCGCTGAGCTTTGAACCGACGGAAAAAACCAGTGAAGGTTTTG

ATAAAATGTACTACGACTATTTTCCGGATGCAGCCAAAATGATTCCGAAATGTAGCACCCAGCTGAAAGCAGTTACC

GCACATTTTCAGACCCATACCACCCCGATTCTGCTGAGCAATAACTTTATTGAACCGCTGGAAATCACCAAAGAGAT

CTACGATCTGAATAACCCGGAAAAAGAGCCGAAAAAATTCCAGACCGCATATGCAAAAAAACCGGTGATCAGAAAG

GTTATCGTGAAGCGCTGTGTAAATGGATTGATTTCACCCGTGATTTTCTGAGCAAATACACCAAAACCACCAGTATC

GATCTGAGCAGCCTGCGTCCGAGCAGCCAGTATAAAGATCTGGGCGAATATTATGCAGAACTGAATCCGCTGCTGTA

TCATATTAGCTTTCAGCGTATTGCCGAGAAAGAAATCATGGACGCAGTTGAAACCGGTAAACTGTACCTGTTCCAGA

TCTACAATAAAGATTTTGCCAAAGGCCATCATGGCAAACCGAATCTGCATACCCTGTATTGGACCGGTCTGTTTAGC

CCTGAAAATCTGGCAAAAACCTCGATTAAACTGAATGGTCAGGCGGAACTGTTTTATCGTCCGAAAAGCCGTATGAA

ACGTATGGCACATCGTCTGGGTGAAAAAATGCTGAACAAAAAACTGAAAGACCAGAAAACCCCGATCCCGGATACAC

TGTATCAAGAACTGTATGATTATGTGAACCATCGTCTGAGCCATGATCTGAGTGATGAAGCACGTGCCCTGCTGCCG

AATGTTATTACCAAAGAAGTTAGCCACGAGATCATTAAAGATCGTCGTTTTACCAGCGACAAATTCTTTTTTCATGT

GCCGATTACCCTGAATTATCAGGCAGCAAATAGCCCGAGCAAATTTAACCAGCGTGTTAATGCATATCTGAAAGAAC

ATCCAGAAACGCCGATTATTGGTATTGATCGTGGTGAACGTAACCTGATTTATATCACCGTTATTGATAGCACCGGC

AAAATCCTGGAACAGCGTAGCCTGAATACCATTCAGCAGTTTGATTACCAGAAAAAACTGGATAATCGCGAGAAAGA

ACGTGTTGCAGCACGTCAGGCATGGTCAGTTGTTGGTACAATTAAAGACCTGAAACAGGGTTATCTGAGCCAGGTTA

TTCATGAAATTGTGGATCTGATGATTCACTATCAGGCCGTTGTTGTGCTGGAAAACCTGAATTTTGGCTTTAAAAGC

AAACGTACCGGCATTGCAGAAAAAGCAGTTTATCAGCAGTTCGAGAAAATGCTGATTGACAAACTGAATTGCCTGGT

GCTGAAAGATTATCCGGCTGAAAAAGTTGGTGGTGTTCTGAATCCGTATCAGCTGACCGATCAGTTTACCAGCTTTG

CAAAAATGGGCACCCAGAGCGGATTTCTGTTTTATGTTCCGGCACCGTATACGAGCAAAATTGATCCGCTGACCGGT

TTTGTTGATCCGTTTGTTTGGAAAACCATCAAAAACCATGAAAGCCGCAAACATTTTCTGGAAGGTTTCGATTTTCT

GCATTACGACGTTAAAACGGGTGATTTCATCCTGCACTTTAAAATGAATCGCAATCTGAGTTTTCAGCGTGGCCTGC

CTGGTTTTATGCCTGCATGGGATATTGTGTTTGAGAAAAACGAAACACAGTTCGATGCAAAAGGCACCCCGTTTATT

GCAGGTAAACGTATTGTTCCGGTGATTGAAAATCATCGTTTCACCGGTCGTTATCGCGATCTGTATCCGGCAAATGA
```

-continued

ACTGATCGCACTGCTGGAAGAGAAAGGTATTGTTTTTCGTGATGGCTCAAACATTCTGCCGAAACTGCTGGAAAATG

ATGATAGCCATGCAATTGATACCATGGTTGCACTGATTCGTAGCGTTCTGCAGATGCGTAATAGCAATGCAGCAACC

GGTGAAGATTACATTAATAGTCCGGTTCGTGATCTGAATGGTGTTTGTTTTGATAGCCGTTTTCAGAATCCGGAATG

GCCGATGGATGCAGATGCAAATGGTGCATATCATATTGCACTGAAAGGACAGCTGCTGCTGAACCACCTGAAAGAAA

GCAAAGATCTGAAACTGCAAAACGGCATTAGCAATCAGGATTGGCTGGCATATATCCAAGAACTGCGTAAC (AsCas12a DNA sequence, codon-optimized for *H. sapiens*)

SEQ ID NO: 340

ATGACCCAGTTTGAAGGTTTCACCAATCTGTATCAGGTTAGCAAAACCCTGCGTTTTGAACTGATTCCGCAGGGTAA

AACCCTGAAACATATTCAAGAACAGGGCTTCATCGAAGAGGATAAAGCACGTAACGATCACTACAAAGAACTGAAAC

CGATTATCGACCGCATCTATAAAACCTATGCAGATCAGTGTCTGCAGCTGGTTCAGCTGGATTGGGAAAATCTGAGC

GCAGCAATTGATAGTTATCGCAAAGAAAAACCGAAGAAACCCGTAATGCACTGATTGAAGAACAGGCAACCTATCG

TAATGCCATCCATGATTATTTCATTGGTCGTACCGATAATCTGACCGATGCAATTAACAAACGTCACGCCGAAATCT

ATAAAGGCCTGTTTAAAGCCGAACTGTTTAATGGCAAAGTTCTGAAACAGCTGGGCACCGTTACCACCACCGAACAT

GAAAATGCACTGCTGCGTAGCTTTGATAAATTCACCACCTATTTCAGCGGCTTTTATGAGAATCGCAAAAACGTGTT

TAGCGCAGAAGATATTAGCACCGCAATTCCGCATCGTATTGTGCAGGATAATTTCCCGAAATTCAAAGAGAACTGCC

ACATTTTTACCCGTCTGATTACCGCAGTTCCGAGCCTGCGTGAACATTTTGAAAACGTTAAAAAAGCCATCGGCATC

TTTGTTAGCACCAGCATTGAAGAAGTTTTTAGCTTCCCGTTTTACAATCAGCTGCTGACCCAGACCCAGATTGATCT

GTATAACCAACTGCTGGGTGGTATTAGCCGTGAAGCAGGCACCGAAAAAATCAAGGTCTGAATGAAGTGCTGAATC

TGGCCATTCAGAAAATGATGAAACCGCACATATTATTGCAAGCCTGCCGCATCGTTTTATTCCGCTGTTCAAACAA

ATTCTGAGCGATCGTAATACCCTGAGCTTTATTCTGGAAGAATTCAAATCCGATGAAGAGGTGATTCAGAGCTTTTG

CAAATACAAAACGCTGCTGCGCAATGAAAATGTTCTGGAAACTGCCGAAGCACTGTTTAACGAACTGAATAGCATTG

ATCTGACCCACATCTTTATCAGCCACAAAAAACTGGAAACCATTTCAAGCGCACTGTGTGATCATTGGGATACCCTG

CGTAATGCCCTGTATGAACGTCGTATTAGCGAACTGACCGGTAAAATTACCAAAAGCGCGAAAGAAAAAGTTCAGCG

CAGTCTGAAACATGAGGATATTAATCTGCAAGAGATTATTAGCGCAGCCGGTAAGAACTGTCAGAAGCATTTAAAC

AGAAAACCAGCGAAATTCTGTCACATGCACATGCAGCACTGGATCAGCCGCTGCCGACCACCCTGAAAAAACAAGAA

GAAAAAGAAATCCTGAAAAGCCAGCTGGATAGCCTGCTGGGTCTGTATCATCTGCTGGACTGGTTTGCAGTTGATGA

AAGCAATGAAGTTGATCCGGAATTTAGCGCACGTCTGACCGGCATTAAACTGGAAATGGAACCGAGCCTGAGCTTTT

ATAACAAAGCCCGTAATTATGCCACCAAAAAACCGTATAGCGTCGAAAAATTCAAACTGAACTTTCAGATGCCGACC

CTGGCAAGCGGTTGGGATGTTAATAAAGAAAAAAACAACGGTGCCATCCTGTTCGTGAAAAATGGCCTGTATTATCT

GGGTATTATGCCGAAACAGAAAGGTCGTTATAAAGCGCTGAGCTTTGAACCGACGGAAAAAACCAGTGAAGGTTTTG

ATAAAATGTACTACGACTATTTTCCGGATGCAGCCAAAATGATTCCGAAATGTAGCACCCAGCTGAAAGCAGTTACC

GCACATTTTCAGACCCATACCACCCCGATTCTGCTGAGCAATAACTTTATTGAACCGCTGGAAATCACCAAAGAGAT

CTACGATCTGAATAACCCGGAAAAAGAGCCGAAAAAATTCCAGACCGCATATGCAAAAAAAACCGGTGATCAGAAAG

GTTATCGTGAAGCGCTGTGTAAATGGATTGATTTCACCCGTGATTTTCTGAGCAAATACACCAAAACCACCAGTATC

GATCTGAGCAGCCTGCGTCCGAGCAGCCAGTATAAAGATCTGGGCGAATATTATGCAGAACTGAATCCGCTGCTGTA

TCATATTAGCTTTCAGCGTATTGCCGAGAAAGAAATCATGGACGCAGTTGAAACCGGTAAACTGTACCTGTTCCAGA

TCTACAATAAAGATTTTGCCAAAGGCCATCATGGCAAACCGAATCTGCATACCCTGTATTGGACCGGTCTGTTTAGC

CCTGAAAATCTGGCAAAAACCTCGATTAAACTGAATGGTCAGGCGGAACTGTTTTATCGTCCGAAAAGCCGTATGAA

ACGTATGGCACATCGTCTGGGTGAAAAAATGCTGAACAAAAAACTGAAAGACCAGAAAACCCCGATCCCGGATACAC

TGTATCAAGAACTGTATGATTATGTGAACCATCGTCTGAGCCATGATCTGAGTGATGAAGCACGTGCCCTGCTGCCG

AATGTTATTACCAAAGAAGTTAGCCACGAGATCATTAAAGATCGTCGTTTTACCAGCGACAAATTCTTTTTTCATGT

GCCGATTACCCTGAATTATCAGGCAGCAAATAGCCCGAGCAAATTTAACCAGCGTGTTAATGCATATCTGAAAGAAC

-continued

```
ATCCAGAAACGCCGATTATTGGTATTGATCGTGGTGAACGTAACCTGATTTATATCACCGTTATTGATAGCACCGGC
AAAATCCTGGAACAGCGTAGCCTGAATACCATTCAGCAGTTTGATTACCAGAAAAAACTGGATAATCGCGAGAAAGA
ACGTGTTGCAGCACGTCAGGCATGGTCAGTTGTTGGTACAATTAAAGACCTGAAACAGGGTTATCTGAGCCAGGTTA
TTCATGAAATTGTGGATCTGATGATTCACTATCAGGCCGTTGTTGTGCTGGAAAACCTGAATTTTGGCTTTAAAAGC
AAACGTACCGGCATTGCAGAAAAAGCAGTTTATCAGCAGTTCGAGAAAATGCTGATTGACAAACTGAATTGCCTGGT
GCTGAAAGATTATCCGGCTGAAAAAGTTGGTGGTGTTCTGAATCCGTATCAGCTGACCGATCAGTTTACCAGCTTTG
CAAAAATGGGCACCCAGAGCGGATTTCTGTTTTATGTTCCGGCACCGTATACGAGCAAAATTGATCCGCTGACCGGT
TTTGTTGATCCGTTTGTTTGGAAAACCATCAAAAACCATGAAAGCCGCAAACATTTTCTGGAAGGTTTCGATTTTCT
GCATTACGACGTTAAAACGGGTGATTTCATCCTGCACTTTAAAATGAATCGCAATCTGAGTTTTCAGCGTGGCCTGC
CTGGTTTTATGCCTGCATGGGATATTGTGTTTGAGAAAAACGAAACACAGTTCGATGCAAAAGGCACCCCGTTTATT
GCAGGTAAACGTATTGTTCCGGTGATTGAAAATCATCGTTTCACCGGTCGTTATCGCGATCTGTATCCGGCAAATGA
ACTGATCGCACTGCTGGAAGAGAAAGGTATTGTTTTTCGTGATGGCTCAAACATTCTGCCGAAACTGCTGGAAAATG
ATGATAGCCATGCAATTGATACCATGGTTGCACTGATTCGTAGCGTTCTGCAGATGCGTAATAGCAATGCAGCAACC
GGTGAAGATTACATTAATAGTCCGGTTCGTGATCTGAATGGTGTTTGTTTTGATAGCCGTTTTCAGAATCCGGAATG
GCCGATGGATGCAGATGCAAATGGTGCATATCATATTGCACTGAAAGGACAGCTGCTGCTGAACCACCTGAAAGAAA
GCAAAGATCTGAAACTGCAAAACGGCATTAGCAATCAGGATTGGCTGGCATATATCCAAGAACTGCGTAAC
```

The wild-type LbCas12a protein amino acid sequence is presented as SEQ ID NO: 3. Polynucleotides codon-optimized for expression in E. coli and human cells are presented in SEQ ID NOS: 341 and 342, respectively. Exemplary variants of LbCas12a protein, the polynucleotides encoding them, as well as exemplary guide RNAs are disclosed in U.S. Patent Application Ser. No. 63/018,592, filed May 1, 2020, (now U.S. patent application Ser. No. 17/245,401, filed Apr. 30, 2021), the contents of which are incorporated by reference herein.

```
(LbCas12a protein amino acid sequence)
                                                          SEQ ID NO: 3
MSKLEKFTNCYSLSKTLRFKAIPVGKTQENIDNKRLLVEDEKRAEDYKGVKKLLDRYYLSFINDVLHSIKLKNLNNY

ISLFRKKTRTEKENKELENLEINLRKEIAKAFKGNEGYKSLFKKDIIETILPEFLDDKDEIALVNSENGETTAFTGE

FDNRENMESEEAKSTSIAFRCINENLTRYISNMDIFEKVDAIFDKHEVQEIKEKILNSDYDVEDFFEGEFFNFVLTQ

EGIDVYNAIIGGFVTESGEKIKGLNEYINLYNQKTKQKLPKFKPLYKQVLSDRESLSFYGEGYTSDEEVLEVFRNTL

NKNSEIFSSIKKLEKLFKNFDEYSSAGIFVKNGPAISTISKDIFGEWNVIRDKWNAEYDDIHLKKKAVVTEKYEDDR

RKSFKKIGSFSLEQLQEYADADLSVVEKLKEIIQKVDEIYKVYGSSEKLFDADFVLEKSLKKNDAVVAIMKDLLDS

VKSFENYIKAFFGEGKETNRDESFYGDFVLAYDILLKVDHIYDAIRNYVTQKPYSKDKFKLYFQNPQFMGGWDKDKE

TDYRATILRYGSKYYLAIMDKKYAKCLQKIDKDDVNGNYEKINYKLLPGPNKMLPKVFFSKKWMAYYNPSEDIQKIY

KNGTFKKGDMFNLNDCHKLIDFFKDSISRYPKWSNAYDENFSETEKYKDIAGFYREVEEQGYKVSFESASKKEVDKL

VEEGKLYMFQIYNKDFSDKSHGTPNLHTMYFKLLFDENNHGQIRLSGGAELFMRRASLKKEELVVHPANSPIANKNP

DNPKKTTTLSYDVYKDKRFSEDQYELHIPIAINKCPKNIFKINTEVRVLLKHDDNPYVIGIDRGERNLLYIVVVDGK

GNIVEQYSLNEIINNENGIRIKTDYHSLLDKKEKERFEARQNWTSIENIKELKAGYISQVVHKICELVEKYDAVIAL

EDLNSGFKNSRVKVEKQVYQKFEKMLIDKLNYMVDKKSNPCATGGALKGYQITNKFESFKSMSTQNGFIFYIPAWLT

SKIDPSTGFVNLLKTKYTSIADSKKFISSFDRIMYVPEEDLFEFALDYKNFSRTDADYIKKWKLYSYGNRIRIFRNP

KKNNVFDWEEVCLTSAYKELFNKYGINYQQGDIRALLCEQSDKAFYSSFMALMSLMLQMRNSITGRTDVDFLISPVK

NSDGIFYDSRNYEAQENAILPKNADANGAYNIARKVLWAIGQFKKAEDEKLDKVKIAISNKEWLEYAQTSVKH (LbCas12a DNA sequence, codon-optimized for E. coli)
                                                         SEQ ID NO: 341
ATGAGTAAGCTGGAGAAATTTACTAATTGTTACTCACTGTCAAAAACGCTGCGTTTCAAAGCGATCCCAGTGGGCAA AACTCAAGAAAATATTGACAATAAACGTTTGCTTGTCGAAGACGAAAAGCGCGCCGAAGACTATAAGGGGGTGAAGA
```

-continued

```
AGCTTCTTGACCGTTACTACCTTTCATTCATCAACGATGTTCTGCACAGCATCAAGTTAAAAAACCTTAACAATTAC
ATTAGTTTGTTTCGCAAGAAGACACGTACAGAGAAAGAGAATAAAGAGCTTGAAAACTTAGAGATTAACCTTCGCAA
GGAGATCGCAAAGGCGTTCAAAGGCAATGAAGGCTATAAGTCGTTATTTAAAAAAGACATCATTGAAACGATTCTGC
CCGAGTTTTTGGATGATAAGGATGAAATCGCCTTAGTTAATTCGTTCAATGGGTTCACTACAGCCTTTACAGGATTC
TTTGATAACCGTGAAAACATGTTTAGCGAGGAAGCAAAAAGCACGAGCATTGCATTTCGCTGCATTAACGAAAATTT
GACTCGTTATATCTCTAACATGGACATCTTTGAGAAGGTTGACGCGATCTTCGATAAGCACGAAGTCCAGGAGATCA
AGGAGAAGATTCTGAACAGCGATTACGACGTTGAAGACTTTTTCGAGGGGGAATTTTTTAACTTTGTGCTTACGCAG
GAAGGAATCGATGTATATAATGCAATTATTGGTGGCTTCGTGACAGAGTCAGGTGAGAAGATTAAAGGATTAAATGA
ATATATCAATTTATACAATCAGAAGACCAAGCAGAAGCTTCCCAAGTTCAAGCCACTGTACAAGCAAGTGTTGTCCG
ACCGCGAGAGCCTTTCCTTTTACGGTGAAGGCTATACCAGTGACGAAGAGGTGTTAGAAGTCTTCCGTAACACGTTA
AACAAAAATTCCGAAATTTTCTCATCCATCAAAAAGCTGGAGAAATTATTTAAGAACTTCGACGAATACAGTAGTGC
AGGGATTTTGTGAAAAATGGACCAGCTATCAGTACTATTTCTAAAGACATCTTCGGGGAATGGAATGTGATTCGCG
ATAAGTGGAATGCTGAGTATGATGATATTCATCTGAAGAAGAAGGCTGTCGTAACGGAGAAGTATGAGGACGATCGC
CGTAAGTCATTCAAAAAAATTGGCTCCTTCAGCCTTGAGCAGCTGCAGGAGTATGCTGATGCTGATCTGTCGGTTGT
CGAGAAGTTAAAAGAGATTATTATCCAAAAGGTAGACGAAATTTATAAGGTCTACGGGAGTAGCGAAAAGTTGTTTG
ATGCTGACTTCGTTTTAGAAAAAAGTTTGAAGAAGAATGATGCGGTCGTTGCCATTATGAAAGATTTGCTGGATAGT
GTTAAATCTTTCGAGAATTACATCAAAGCCTTTTTTGGTGAAGGGAAAGAGACTAATCGCGACGAGTCTTTCTACGG
AGATTTTGTGTTAGCGTACGATATCCTGTTGAAGGTAGACCACATCTATGACGCTATTCGCAATTATGTCACACAAA
AACCATATTCTAAGGACAAGTTCAAATTGTACTTTCAGAACCCCCAATTCATGGGCGGATGGGACAAGGATAAGGAA
ACAGACTACCGTGCGACGATTTTGCGCTACGGTAGCAAATACTACCTGGCTATCATGGACAAAAAGTACGCAAAATG
TTTACAGAAAATTGACAAGGATGACGTCAACGGTAACTATGAAAAAATCAATTACAAATTACTGCCTGGGCCAAATA
AGATGCTGCCAAAAGTGTTCTTTAGTAAGAAATGGATGGCCTACTATAATCCGTCTGAGGACATCCAAAAAATCTAC
AAAAACGGCACGTTCAAGAAGGGAGATATGTTCAATTTAAACGATTGTCACAAATTAATCGATTTTTTTAAAGATTC
CATTTCCCGTTATCCAAAGTGGTCCAATGCATATGACTTCAACTTTAGCGAGACCGAGAAATACAAGGATATCGCCG
GATTCTATCGTGAGGTGGAGGAACAAGGTTACAAGGTCTCCTTTGAGTCAGCCTCTAAAAAGGAGGTTGATAAATTG
GTGGAGGAGGGCAAATTGTATATGTTCCAAATTTACAACAAAGACTTCTCTGACAAGAGTCATGGCACTCCTAACTT
GCACACTATGTATTTCAAATTGTTTATTTGATGAAAATAATCATGGTCAAATCCGTTTGTCAGGCGGTGCAGAATTGT
TCATGCGTCGCGCTAGCTTAAAGAAGGAGGAGTTAGTAGTACACCCGGCTAACAGTCCGATCGCTAACAAAAACCCG
GACAATCCCAAAAAAACAACTACGCTGAGTTACGACGTGTATAAAGATAAACGCTTCTCAGAGGACCAATATGAACT
GCATATCCCCATCGCCATCAATAAGTGCCCCAAGAACATTTTCAAGATCAATACGGAAGTACGCGTCCTGTTGAAGC
ACGATGATAACCCGTACGTCATTGGTATCGACCGCGGTGAACGCAATTTACTTTATATCGTCGTAGTGGACGGTAAA
GGCAACATTGTAGAGCAATATTCCTTAAACGAGATCATCAATAATTTTAACGGCATCCGCATTAAAACAGATTACCA
CTCTCTGCTGGATAAAAAGAGAAAGAGCGTTTCGAAGCTCGTCAGAATTGGACCTCCATCGAGAATATCAAAGAGC
TTAAAGCGGGGTACATTTCACAGGTGGTGCATAAGATTTGCGAGTTGGTAGAAAAATACGACGCCGTAATCGCATTG
GAGGATCTGAATTCGGGTTTCAAAAACAGCCGTGTTAAGGTTGAAAAACAAGTCTATCAAAAATTCGAAAAGATGTT
AATTGACAAATTGAACTATATGGTTGATAAAAAGTCGAATCCATGTGCGACAGGGGGGCATTAAAGGGATATCAGA
TTACTAATAAATTCGAATCGTTCAAGAGCATGAGCACTCAAAATGGCTTCATCTTTTACATCCCAGCATGGCTGACC
TCGAAAATTGATCCTTCCACAGGTTTCGTCAACCTTTTGAAGACTAAGTATACTAGTATTGCGGACTCGAAGAAGTT
CATCAGTTCTTTCGACCGTATTATGTATGTGCCGGAGGAGGATCTGTTTGAGTTCGCATTGGATTATAAGAATTTCA
GCCGCACCGACGCGGACTACATTAAAAAATGGAAATTATACTCATACGGAAATCGCATTCGTATCTTTCGTAATCCC
```

-continued

```
AAAAAGAACAATGTTTTCGACTGGGAGGAAGTGTGCCTTACTTCGGCGTATAAGGAGCTTTTCAACAAATACGGAAT

TAACTACCAGCAGGGCGATATTCGCGCCCTGTTATGTGAACAATCTGATAAAGCGTTTTACAGCTCCTTTATGGCAT

TAATGTCCTTAATGTTGCAGATGCGCAACTCGATCACGGGTCGTACAGACGTTGATTTCTTAATCTCACCGGTTAAG

AACAGTGACGGCATCTTCTACGACTCTCGCAACTACGAGGCACAGGAGAATGCCATCTTACCCAAGAACGCAGATGC

AAATGGTGCGTACAATATCGCTCGTAAAGTCCTTTGGGCAATCGGCCAATTCAAGAAGGCTGAAGACGAGAAGCTGG

ACAAGGTGAAAATCGCGATTTCTAATAAGGAATGGCTGGAGTATGCGCAGACGAGTGTAAAGCAC
```

(LbCas12a DNA sequence, codon-optimized for *H. sapiens*)

SEQ ID NO: 342

```
ATGTCTAAACTGGAGAAATTCACTAATTGCTACTCCTTGTCAAAAACATTGCGATTTAAAGCTATACCCGTTGGTAA

GACTCAGGAAAACATCGACAACAAACGGCTTCTGGTAGAGGACGAAAAACGCGCCGAGGATTATAAAGGAGTAAAAA

AACTGTTGGACAGGTACTACCTGAGTTTCATCAATGACGTGCTGCATAGTATTAAACTGAAAAACCTCAACAATTAC

ATCTCTCTGTTTAGAAAAAAGACACGGACGGAAAAGGAGAATAAAGAATTGGAGAATCTTGAGATAAACCTGCGCAA

GGAAATAGCCAAGGCATTCAAAGGAAACGAAGGCTACAAGTCCTTGTTTAAAAAGGATATTATCGAGACCATACTTC

CCGAGTTTTTGGACGACAAAGACGAAATCGCTCTGGTGAACTCTTTTAATGGCTTTACTACAGCCTTTACAGGATTT

TTTGACAACAGAGAGAATATGTTCTCTGAGGAGGCAAAGTCTACCAGCATTGCCTTCCGATGTATAAACGAAAACCT

GACAAGATATATATCAAACATGGACATTTTTGAAAAAGTTGATGCGATATTTGACAAACACGAGGTCCAAGAGATAA

AGGAAAAAATCCTGAACTCAGATTACGACGTGGAAGATTTTTTTGAGGGTGAGTTTTTCAATTTCGTTCTTACGCAG

GAGGGGATCGACGTATATAACGCTATCATTGGGGGCTTCGTTACCGAATCTGGAGAAAAGATCAAAGGCCTTAACGA

GTATATAAATCTGTACAATCAGAAAACGAAGCAAAAGCTCCCAAAGTTCAAGCCCCTTTATAAACAGGTCCTTAGTG

ACCGGGAAAGCCTCTCTTTCTATGGAGAAGGGTACACCTCCGATGAAGAGGTTCTGGAGGTGTTCCGAAATACTCTC

AATAAAAACTCTGAAATTTTCAGCAGCATCAAAAAATTGGAGAAGCTCTTTAAAAATTTCGACGAATATTCCTCTGC

TGGAATATTTGTGAAGAACGGACCCGCAATCTCTACCATAAGCAAGGATATCTTTGGTAATGGAATGTAATTAGAG

ATAAATGGAATGCGGAGTACGATGACATCCACCTCAAAAAAAGGCTGTCGTAACGGAGAAATACGAAGATGACCGC

AGAAAGAGTTTCAAAAAAATCGGTTCTTTTTCACTGGAACAGCTCCAGGAATACGCGGATGCCGACTTGAGCGTTGT

AGAAAAACTGAAAGAATAATTATCCAGAAAGTAGATGAGATTTACAAAGTGTATGGGAGCAGCGAAAAACTTTTTG

ATGCAGATTTTGTACTTGAAAAAAGTCTTAAAAAAAATGATGCAGTTGTCGCCATTATGAAAGATCTCCTCGACAGT

GTAAAATCTTTTGAGAATTACATCAAGGCTTTTTTTGGCGAGGGCAAGGAGACGAATAGGGATGAAAGTTTTTATGG

TGACTTTGTACTTGCTTACGACATCCTGCTCAAGGTCGATCATATTTACGATGCTATACGCAATTACGTGACACAGA

AACCGTACTCTAAAGATAAGTTTAAGTTGTATTTCCAGAATCCTCAGTTCATGGGTGGCTGGGACAAGGATAAGGAG

ACAGATTATCGAGCGACTATTTTGCGCTATGGCTCTAAGTATTACCTCGCTATAATGGACAAAAAGTACGCTAAATG

CCTGCAGAAAATTGATAAGGACGACGTGAACGGTAACTATGAGAAAATTAACTATAAGTTGTTGCCCGGCCCTAATA

AGATGCTGCCGAAAGTCTTTTTCTCCAAAAAGTGGATGGCGTACTACAATCCATCAGAAGATATCCAGAAGATATAC

AAGAATGGCACCTTTAAGAAAGGAGATATGTTTAACCTTAACGACTGTCACAAGTTGATTGACTTCTTTAAGGATAG

CATTTCTCGATACCCAAAGTGGTCTAATGCATATGATTTCAATTTCTCTGAGACGGAGAAGTATAAAGACATTGCGG

GGTTCTACCGAGAAGTCGAAGAACAAGGGTACAAGGTAAGTTTTGAATCTGCTTCAAAAAAAGAGGTAGACAAACTG

GTAGAAGAGGGAAAACTCTACATGTTCCAGATCTATAATAAGGACTTCTCTGACAAAAGTCACGGTACTCCGAACCT

CCATACGATGTACTTCAAGCTGCTTTTTGATGAAAACAATCATGGCCAGATACGCCTCAGTGGAGGAGCGGAATTGT

TTATGCGCCGCGCCTCCCTGAAGAAAGAAGAGCTGGTAGTACATCCTGCCAATTCCCCAATCGCAAACAAAAATCCG

GATAATCCTAAAAAGACCACTACGTTGAGCTACGACGTTTACAAGGATAAGAGATTTTCCGAGGATCAGTACGAGCT

TCATATCCCTATCGCCATAAATAAGTGCCCAAAGAATATTTTCAAAATAAACACGGAAGTAAGAGTACTGCTCAAGC

ATGATGATAATCCCTACGTAATTGGAATTGATAGGGGGAACGGAACTTGCTTTATATAGTCGTCGTCGATGGCAAA

GGGAACATTGTTGAACAATACTCTCTGAATGAGATCATCAACAACTTCAACGGTATCCGCATTAAAACTGATTATCA
```

-continued

```
TTCTCTCCTGGACAAAAAAGAAAAGGAAAGGTTCGAAGCGCGCCAGAACTGGACTTCAATTGAAAACATTAAGGAGC
TCAAAGCTGGCTATATATCTCAGGTTGTCCATAAGATATGCGAACTGGTAGAAAAATATGATGCCGTCATTGCTCTC
GAGGACCTGAACAGCGGTTTTAAGAACAGCCGGGTCAAAGTCGAAAAGCAGGTCTATCAAAAGTTCGAGAAGATGCT
CATAGACAAACTCAACTATATGGTCGATAAGAAGTCTAACCCGTGTGCTACGGGAGGGGCACTGAAGGGATACCAGA
TCACGAATAAGTTTGAATCATTCAAAAGCATGAGTACCCAAAATGGATTTATTTTCTACATTCCCGCGTGGTTGACC
TCAAAAATCGACCCTAGTACAGGATTCGTGAACCTGCTGAAGACTAAGTACACTAGTATTGCGGATAGCAAGAAATT
TATAAGCTCTTTTGACCGCATTATGTACGTACCCGAAGAAGATTTGTTTGAGTTCGCTCTCGACTACAAAAATTTTA
GCAGAACCGACGCCGATTACATAAAGAAGTGGAAACTCTACTCTTATGGGAACCGCATACGCATATTCCGAAACCCT
AAAAAAAACAATGTATTCGATTGGGAAGAGGTTTGCCTGACCAGCGCGTACAAAGAGCTTTTTAACAAGTATGGTAT
AAATTATCAGCAGGGTGACATCCGCGCCTTGTTGTGTGAGCAAAGTGACAAGGCGTTCTACAGTTCATTTATGGCGT
TGATGTCCCTCATGTTGCAGATGCGAAATTCCATCACGGGAGGACAGATGTAGATTTCCTCATCTCTCCGGTCAAG
AACAGTGATGGCATCTTTTACGACAGCCGGAATTACGAGGCGCAGGAGAATGCCATACTCCCTAAGAATGCGGACGC
GAACGGAGCATATAACATCGCGCGAAAAGTCCTGTGGGCTATTGGTCAATTCAAAAAGGCTGAAGATGAGAAGTTGG
ACAAGGTGAAGATAGCCATTAGTAACAAGGAATGGTTGGAGTACGCTCAGACATCAGTGAAACAT
```

Example 9

Sequences of Fluorescent Proteins

SEQ ID NO: 4 (eGFP protein amino acid sequence)
(Cormack et al. (1996)).
MVSKGEELFTGVVPILVELDGDVNGHKFSVSGEGEGDATYGKLTLKFIC
TTGKLPVPWPTLVTTLTYGVQCFSRYPDHMKQHDFFKSAMPEGYVQERT
IFFKDDGNYKTRAEVKFEGDTLVNRIELKGIDFKEDGNILGHKLEYNYN
SHNVYIMADKQKNGIKVNFKIRHNIEDGSVQLADHYQQNTPIGDGPVLL
PDNHYLSTQSALSKDPNEKRDHMVLLEFVTAAGITLGMDELYK SEQ ID NO: 343 eGFP DNA sequence
(codon-optimized for E. coli)
ATGGTAAGTAAAGGTGAAGAGCTTTTTACAGGTGTGGTGCCCATCCTTG
TGGAGTTGGACGGTGATGTCAATGGCCATAAATTTTCTGTGTCTGGTGA
AGGGGAAGGGGACGCGACGTATGGAAAACTTACCCTGAAGTTTATCTGC
ACGACAGGTAAGTTGCCAGTACCGTGGCCTACCCTGGTCACCACATTAA
CATATGGTGTTCAATGCTTTTCACGCTACCCTGACCACATGAAACAACA
TGACTTTTTTAAAAGTGCCATGCCAGAGGGCTACGTGCAGGAACGCACA
ATCTTTTTCAAAGACGACGGCAATTATAAAACACGCGCGGAGGTAAAGT
TGAGGGAGACACACTGGTTAATCGCATCGAACTGAAGGCATTGACTT
TAAGGAGGATGGGAATATCTTAGGCCATAAACTGGAGTATAACTATAAC
TCTCACAACGTCTATATTATGGCGGACAAGCAAAAGAATGGTATCAAGG
TAAACTTTAAGATTCGTCATAACATTGAGGATGGGAGCGTGCAGTTGGC
TGACCACTATCAGCAGAATACTCCCATTGGCGACGGCCCCGTGCTTTTA
CCTGACAATCACTATCTTTCTACGCAGTCAGCTTTGTCCAAAGACCCCA
ACGAGAGCGTGATCACATGGTTCTTCTGGAATTCGTCACAGCCGCCGG
AATCACTTTAGGCATGGACGAACTTTATAAA SEQ ID NO: 344 eGFP DNA sequence
(codon-optimized for H. sapiens)
ATGGTCTCAAAAGGCGAAGAATTGTTCACCGGTGTAGTCCCTATCTTGG
TGGAGCTTGACGGCGATGTTAATGGCCATAAATTTAGTGTGTCCGGCGA
AGGTGAGGGCGACGCCACATATGGTAAACTTACGCTTAAATTTATTTGC
ACGACGGGAAAGCTCCCCGTGCCGTGGCCAACCCTTGTAACTACCCTTA
CGTACGGGGTGCAGTGCTTCAGTAGGTATCCCGACCATATGAAGCAGCA
CGATTTTTTCAAAGTGCTATGCCCGAGGGGTATGTGCAAGAGAGGACT
ATATTCTTTAAGGATGATGGGAATTACAAGACGCAGCCGAGGTTAAGT
TCGAAGGTGATACGCTTGTAAATCGAATCGAATTGAAAGGGATTGACTT
TAAGGAAGACGGAAATATACTTGGACACAAATTGGAATATAACTACAAC
AGCCACAACGTCTATATAATGGCCGACAAGCAAAGAACGGAATAAAAG
TCAACTTTAAGATTCGACAATATAAGGATGGATCCGTGCAGCTTGC
TGACCACTATCAGCAGAACACTCCGATAGGCGATGGACCAGTGCTGCTT
CCCGACAATCACTACCTCTCCACGCAGTCTGCTCTGTCTAAAGACCCTA
ATGAAAAACGAGACCACATGGTGCTGCTCGAATTTGTCACTGCCGCCGG
GATTACCTTGGGAATGGACGAACTGTATAAG SEQ ID NO: 5 (mCherry amino acid sequence)
(Shaner et al. (12004).
MVSKGEEDNMAIIKEFMRFKVHMEGSVNGHEFEIEGEGEGRPYEGTQTA
KLKVTKGGPLPFAWDILSPQFMYGSKAYVKHPADIPDYLKLSFPEGFKW
ERVMNFEDGGVVTVTQDSSLQDGEFIYKVKLRGTNFPSDGPVMQKKTMG
WEASSERMYPEDGALKGEIKQRLKLKDGGHYDAEVKTTYKAKKPVQLPG
AYNVNIKLDITSHNEDYTIVEQYERAEGRHSTGGMDELYK SEQ ID NO: 345 (mCherry DNA sequence
codon-optimized for E. coli)
ATGGTGTCCAAAGGAGAAGAGGATAACATGGCGATCATCAAGGAATTTA
TGCGTTTCAAAGTTCACATGGAGGGAAGCGTAAACGGCCATGAATTTGA
GATTGAGGGGGAAGGCGAAGGCCGTCCATACGAAGGCACTCAAACCGCC
AAGCTTAAGGTTACCAAGGGAGGTCCGCTTCCTTTCGCCTGGGATATCC
TTAGCCCACAGTTCATGTATGGCTCTAAAGCATACGTCAAGCACCCTGC
AGACATTCCTGATTATTTGAAACTTAGTTTTCCTGAGGGTTTTAAGTGG
GAACGCGTTATGAATTTCGAGGATGGAGGAGTAGTGACAGTAACTCAAG
ATTCCAGTCTTCAAGACGGAGAGTTTATCTACAAGGTGAAATTACGTGG
CACGAACTTTCCATCCGACGGGCCAGTGATGCAGAAGAAAACCATGGGT
TGGGAGGCATCTTCTGAGCGTATGTACCCGGAAGACGGGGCGTTGAAAG
GCGAAATCAAGCAGCGCCTGAAGTTGAAAGACGGGGGTCACTACGATGC
GGAAGTAAAAACTACATATAAGGCCAAGAAGCCCGTCCAGCTTCCGGGC
GCGTACAACGTCAACATCAAATTGGACATTACTTCCCACAACGAGGATT
ACACTATTGTTGAACAATATGAGCGTGCGGAGGGACGCCATTCAACCGG
GGGGATGGATGAGCTTTACAAG SEQ ID NO: 346 (mCherry DNA sequence
codon-optimized for H. sapiens)
ATGGTCAGTAAGGGGGAAGAGGACAACATGGCGATAATCAAGGAATTTA
TGAGATTTAAGGTCCATATGGAAGGCTCTGTCAACGGTCATGAGTTCGA
AATTGAGGGGGAGGGGAAGGCCGCCCATATGAGGGGACTCAAACAGCC
AAACTTAAGGTCACAAAAGGAGGTCCTCTGCCCTTCGCGTGGGACATAC
TCAGCCCACATTCATGTATGGAAGTAAGGCATATGTTAAACACCCGGC
GGACATACCCGACTACCTCAAACTGTCATTTCCTGAGGGTTTTAAGTGG
GAGAGGGTTATGAATTTCGAGGACGGTGGAGTAGTAACAGTGACACAAG
ACTCTTCTCTCCAGGATGGAGAATTTATATACAAAGTGAAACTGCGGGA
CACTAACTTTCCGTCAGACGGCCCAGTAATGCAAAAGAAAACTATGGGG
TGGGAGGCTTCCAGCGAGCGCATGTATCCCGAGGATGGGCCCTTAAGG
GAGAAATAAAACAACGCTTGAAGCTCAAAGACGGGGGACACTATGATGC
GGAGGTCAAAACGACCTACAAAGCAAAAAAGCCAGTACGCTTCCGGGA
GCTTATAACGTGAATATAAAGCTCGATATAACCTCACACAACGAGGACT
ACACGATTGTAGAACAATACGAAAGCCGAGGGGAGACATAGTACGGG
GGGCATGGACGAACTTTACAAG
```

Example 10

Sequences of Chimeric Proteins

Table V.1 provides chimera fusion proteins between Cas9 amino acid sequences, linker amino acid sequences (underlined), and eGFP amino acid sequences (bolded, italicized).

TABLE V.1

Cas9-Linker-eGFP Chimeras

SEQ ID NO: 38
MDKKYSIGLDIGINSVGWAVITDEYKVPSKKEKVLGNTDRHSIKKNLIGALLFDSGETAEATRLKRTARRRYTRRK
NRICYLQEIFSNEMAKVDDSFFHRLEESFLVEEDKKHERHPIFGNIVDEVAYHEKYPTIYHLRKKLVDSTDKADLR
LIYLALAHMIKFRGHFLIEGDLNPDNSDVDKLFIQLVQTYNQLFEENPINASGVDAKAILSARLSKSRRLENLIAQ
LPGEKKNGLEGNLIALSLGLIPNEKSNEDLAEDAKLQLSKDTYDDDLDNLLAQIGDQYADLFLAAKNLSDAILLSD
ILRVNTEITKAPLSASMIKRYDEHHQDLTLLKALVRQQLPEKYKEIFFDQSKNGYAGYIDGGASQEEFYKFIKPIL
EKMDGTEELLVKLNREDLLRKQRTFDNGSIPHQIHLGELHAILRRQEDFYPFLKDNREKIEKILTFRIPYYVGPLA
RGNSRFAWMTRKSEETITPWNFEEVVDKGASAQSFIERMTNEDKNLPNEKVLPKHSLLYEYFTVYNELTKVKYTE
GMRKPAFLSGEQKKAIVDLLFKINRKVIVKQLKEDYFKKIECFDSVEISGVEDRFNASLGTYHDLLKIIKDKDFLD
NEENEDILEDIVLTLTLFEDREMIEERLKTYAHLFDDKVMKQLKRRRYTGWGRLSRKLINGIRDKQSGKTILDFLK
SDGFANRNFMQLIHDDSLTFKEDIQKAQVSGQGDSLHEHIANLAGSPAIKKGILQTVKVVDELVKVMGRHKPENIV
IEMARENQTTQKGQKNSRERMKRIEEGIKELGSQILKEHPVENTQLQNEKLYLYYLQNGRDMYVDQELDINRLSDY
DVDHIVPQSFLKDDSIDNKVLTRSDKNRGKSDNVPSEEVVKKMKNYWRQLLNAKLITQRKEDNLIKAERGGLSELD
KAGFIKRQLVETRQITKHVAQILDSRMNTKYDENDKLIREVKVITLKSKLVSDERKDFQFYKVREINNYHHAHDAY
LNAVVGTALIKKYPKLESEFVYGDYKVYDVRKMIAKSEQEIGKATAKYFFYSNIMNFFKTEITLANGEIRKRPLIE
TNGETGEIVWDKGRDFATVRKVLSMPQVNIVKKTEVQTGGFSKESILPKRNSDKLIARKKDWDPKKYGGFDSPTVA
YSVLVVAKVEGKSKKLKSVKELLGITIMERSSFEKNPIDFLEAKGYKEVKKDLIIKLPKYSLFELENGRKRMLAS
AGELQKGNELALPSKYVNFLYLASHYEKLKGSPEDNEQKQLFVEQHKYLDEIIEQISEFSKRVILADANLDKVLS
AYNKHRDKPIREQAENIIHLFTLTNLGAPAAFKYFDTTIDRKRYTSTKEVLDATLIHQSITGLYETRIDLSQLGGD
GSAGSAAGSGEE*MVSKGEELFTGVVPILVELDGDVNGHKFSVSGEGEGDATYGKLTLKFICTTGKLPVPWPTLVTT*
*LTYGVQCFSRYPDHMKQHDFFKSAMPEGYVQERTIFFKDDGNYKTRAEVKFEGDTLVNRIELKGIDFKEDGNILGH*
*KLEYNYNSHNVYIMADKQKNGIKVNFKIRHNIEDGSVQLADHYQQNTPIGDGPVLLPDNHYLSTQSALSKDPNEKR*
*DHMVLLEFVTAAGITLGMDELYK*

SEQ ID NO: 39
MDKKYSIGLDIGINSVGWAVITDEYKVPSKKEKVLGNTDRHSIKKNLIGALLFDSGETAEATRLKRTARRRYTRRK
NRICYLQEIFSNEMAKVDDSFFHRLEESFLVEEDKKHERHPIFGNIVDEVAYHEKYPTIYHLRKKLVDSTDKADLR
LIYLALAHMIKFRGHFLIEGDLNPDNSDVDKLFIQLVQTYNQLFEENPINASGVDAKAILSARLSKSRRLENLIAQ
LPGEKKNGLEGNLIALSLGLIPNEKSNEDLAEDAKLQLSKDTYDDDLDNLLAQIGDQYADLFLAAKNLSDAILLSD
ILRVNTEITKAPLSASMIKRYDEHHQDLTLLKALVRQQLPEKYKEIFFDQSKNGYAGYIDGGASQEEFYKFIKPIL
EKMDGTEELLVKLNREDLLRKQRTFDNGSIPHQIHLGELHAILRRQEDFYPFLKDNREKIEKILTFRIPYYVGPLA
RGNSRFAWMTRKSEETITPWNFEEVVDKGASAQSFIERMTNEDKNLPNEKVLPKHSLLYEYFTVYNELTKVKYTE
GMRKPAFLSGEQKKAIVDLLFKINRKVIVKQLKEDYFKKIECFDSVEISGVEDRFNASLGTYHDLLKIIKDKDFLD
NEENEDILEDIVLTLTLFEDREMIEERLKTYAHLFDDKVMKQLKRRRYTGWGRLSRKLINGIRDKQSGKTILDFLK
SDGFANRNFMQLIHDDSLTFKEDIQKAQVSGQGDSLHEHIANLAGSPAIKKGILQTVKVVDELVKVMGRHKPENIV
IEMARENQTTQKGQKNSRERMKRIEEGIKELGSQILKEHPVENTQLQNEKLYLYYLQNGRDMYVDQELDINRLSDY
DVDHIVPQSFLKDDSIDNKVLTRSDKNRGKSDNVPSEEVVKKMKNYWRQLLNAKLITQRKEDNLIKAERGGLSELD
KAGFIKRQLVETRQITKHVAQILDSRMNTKYDENDKLIREVKVITLKSKLVSDERKDFQFYKVREINNYHHAHDAY
LNAVVGTALIKKYPKLESEFVYGDYKVYDVRKMIAKSEQEIGKATAKYFFYSNIMNFFKTEITLANGEIRKRPLIE
TNGETGEIVWDKGRDFATVRKVLSMPQVNIVKKTEVQTGGFSKESILPKRNSDKLIARKKDWDPKKYGGFDSPTVA
YSVLVVAKVEGKSKKLKSVKELLGITIMERSSFEKNPIDFLEAKGYKEVKKDLIIKLPKYSLFELENGRKRMLAS
AGELQKGNELALPSKYVNFLYLASHYEKLKGSPEDNEQKQLFVEQHKYLDEIIEQISEFSKRVILADANLDKVLS
AYNKHRDKPIREQAENIIHLFTLTNLGAPAAFKYFDTTIDRKRYTSTKEVLDATLIHQSITGLYETRIDLSQLGGD
GGGGSGGGGSGGGGSGGGGS*MVSKGEELFTGVVPILVELDGDVNGHKFSVSGEGEGDATYGKLTLKFICTTGKLPV*
*PWPTLVTTLTYGVQCFSRYPDHMKQHDFFKSAMPEGYVQERTIFFKDDGNYKTRAEVKFEGDTLVNRIELKGIDFK*
*EDGNILGHKLEYNYNSHNVYIMADKQKNGIKVNFKIRHNIEDGSVQLADHYQQNTPIGDGPVLLPDNHYLSTQSAL*
*SKDPNEKRDHMVLLEFVTAAGITLGMDELYK*

SEQ ID NO: 40
MDKKYSIGLDIGINSVGWAVITDEYKVPSKKEKVLGNTDRHSIKKNLIGALLFDSGETAEATRLKRTARRRYTRRK
NRICYLQEIFSNEMAKVDDSFFHRLEESFLVEEDKKHERHPIFGNIVDEVAYHEKYPTIYHLRKKLVDSTDKADLR
LIYLALAHMIKFRGHFLIEGDLNPDNSDVDKLFIQLVQTYNQLFEENPINASGVDAKAILSARLSKSRRLENLIAQ
LPGEKKNGLEGNLIALSLGLIPNEKSNEDLAEDAKLQLSKDTYDDDLDNLLAQIGDQYADLFLAAKNLSDAILLSD
ILRVNTEITKAPLSASMIKRYDEHHQDLTLLKALVRQQLPEKYKEIFFDQSKNGYAGYIDGGASQEEFYKFIKPIL
EKMDGTEELLVKLNREDLLRKQRTFDNGSIPHQIHLGELHAILRRQEDFYPFLKDNREKIEKILTFRIPYYVGPLA
RGNSRFAWMTRKSEETITPWNFEEVVDKGASAQSFIERMTNEDKNLPNEKVLPKHSLLYEYFTVYNELTKVKYTE
GMRKPAFLSGEQKKAIVDLLFKINRKVIVKQLKEDYFKKIECFDSVEISGVEDRFNASLGTYHDLLKIIKDKDFLD
NEENEDILEDIVLTLTLFEDREMIEERLKTYAHLFDDKVMKQLKRRRYTGWGRLSRKLINGIRDKQSGKTILDFLK
SDGFANRNFMQLIHDDSLTFKEDIQKAQVSGQGDSLHEHIANLAGSPAIKKGILQTVKVVDELVKVMGRHKPENIV
IEMARENQTTQKGQKNSRERMKRIEEGIKELGSQILKEHPVENTQLQNEKLYLYYLQNGRDMYVDQELDINRLSDY
DVDHIVPQSFLKDDSIDNKVLTRSDKNRGKSDNVPSEEVVKKMKNYWRQLLNAKLITQRKEDNLIKAERGGLSELD
KAGFIKRQLVETRQITKHVAQILDSRMNTKYDENDKLIREVKVITLKSKLVSDERKDFQFYKVREINNYHHAHDAY
LNAVVGTALIKKYPKLESEFVYGDYKVYDVRKMIAKSEQEIGKATAKYFFYSNIMNFFKTEITLANGEIRKRPLIE
TNGETGEIVWDKGRDFATVRKVLSMPQVNIVKKTEVQTGGFSKESILPKRNSDKLIARKKDWDPKKYGGFDSPTVA
YSVLVVAKVEGKSKKLKSVKELLGITIMERSSFEKNPIDFLEAKGYKEVKKDLIIKLPKYSLFELENGRKRMLAS
AGELQKGNELALPSKYVNFLYLASHYEKLKGSPEDNEQKQLFVEQHKYLDEIIEQISEFSKRVILADANLDKVLS
AYNKHRDKPIREQAENIIHLFTLTNLGAPAAFKYFDTTIDRKRYTSTKEVLDATLIHQSITGLYETRIDLSQLGGD
AEAAAKEAAAAKEAAAAKEAAAAK*MVSKGEELFTGVVPILVELDGDVNGHKFSVSGEGEGDATYGKLTLKFICTTGKL*
*PVPWPTLVTTLTYGVQCFSRYPDHMKQHDFFKSAMPEGYVQERTIFFKDDGNYKTRAEVKFEGDTLVNRIELKGID*

TABLE V.1-continued

Cas9-Linker-eGFP Chimeras

FKEDGNILGHKLEYNYNSHNVYIMADKQKNGIKVNFKIRHNIEDGSVQLADHYQQNTPIGDGPVLLPDNHYLSTQS
ALSKDPNEKRDHMVLLEFVTAAGITLGMDELYK

SEQ ID NO: 41
MDKKYSIGLDIGINSVGWAVITDEYKVPSKKEKVLGNTDRHSIKKNLIGALLFDSGETAEATRLKRTARRRYTRRK
NRICYLQEIFSNEMAKVDDSFFHRLEESFLVEEDKKHERHPIFGNIVDEVAYHEKYPTIYHLRKKLVDSTDKADLR
LIYLALAHMIKFRGHFLIEGDLNPDNSDVDKLFIQLVQTYNQLFEENPINASGVDAKAILSARLSKSRRLENLIAQ
LPGEKKNGLEGNLIALSLGLIPNEKSNEDLAEDAKLQLSKDTYDDDLDNLLAQIGDQYADLFLAAKNLSDAILLSD
ILRVNTEITKAPLSASMIKRYDEHHQDLTLLKALVRQQLPEKYKEIFFDQSKNGYAGYIDGGASQEEFYKFIKPIL
EKMDGTEELLVKLNREDLLRKQRTFDNGSIPHQIHLGELHAILRRQEDFYPFLKDNREKIEKILTFRIPYYVGPLA
RGNSRFAWMTRKSEETITPWNFEEVVDKGASAQSFIERMTNEDKNLPNEKVLPKHSLLYEYFTVYNELTKVKYVTE
GMRKPAFLSGEQKKAIVDLLFKINRKVIVKQLKEDYFKKIECFDSVEISGVEDRFNASLGTYHDLLKIIKDKDFLD
NEENEDILEDIVLTLTLFEDREMIEERLKTYAHLFDDKVMKQLKRRRYTGWGRLSRKLINGIRDKQSGKTILDFLK
SDGFANRNFMQLIHDDSLTFKEDIQKAQVSGQGDSLHEHIANLAGSPAIKKGILQTVKVVDELVKVMGRHKPENIV
IEMARENQTTQKGQKNSRERMKRIEEGIKELGSQILKEHPVENTQLQNEKLYLYYLQNGRDMYVDQELDINRLSDY
DVDHIVPQSFLKDDSIDNKVLTRSDKNRGKSDNVPSEEVVKKMKNYWRQLLNAKLITQRKEDNLIKAERGGLSELD
KAGFIKRQLVETRQITKHVAQILDSRMNTKYDENDKLIREVKVITLKSKLVSDERKDFQFYKVREINNYHHAHDAY
LNAVVGTALIKKYPKLESEFVYGDYKVYDVRKMIAKSEQEIGKATAKYFFYSNIMNFFKTEITLANGEIRKRPLIE
TNGETGEIVWDKGRDFATVRKVLSMPQVNIVKKTEVQTGGESKESILPKRNSDKLIARKKDWDPKKYGGFDSPTVA
YSVLVVAKVEKGKSKKLKSVKELLGITIMERSSFEKNPIDFLEAKGYKEVKKDLIIKLPKYSLFELENGRKRMLAS
AGELQKGNELALPSKYVNFLYLASHYEKLKGSPEDNEQKQLFVEQHKHYLDEIIEQISEFSKRVILADANLDKVLS
AYNKHRDKPIREQAENIIHLFTLTNLGAPAAFKYFDTTIDRKRYTSTKEVLDATLIHQSITGLYETRIDLSQLGGD
AEAAAKEAAAKEAAAKEAAAKALEAEAAAKEAAAKEAAAKEAAAKEAAAKALE*MVSKGEELFTGVVPILVELDGDVNGHKFSV
SGEGEGDATYGKLTLKFICTTGKLPVPWPTLVTTLTYGVQCFSRYPDHMKQHDFFKSAMPEGYVQERTIFFKDDGN
YKTRAEVKFEGDTLVNRIELKGIDFKEDGNILGHKLEYNYNSHNVYIMADKQKNGIKVNFKIRHNIEDGSVQLADH
YQQNTPIGDGPVLLPDNHYLSTQSALSKDPNEKRDHMVLLEFVTAAGITLGMDELYK*

SEQ ID NO: 42
MDKKYSIGLDIGINSVGWAVITDEYKVPSKKEKVLGNTDRHSIKKNLIGALLFDSGETAEATRLKRTARRRYTRRK
NRICYLQEIFSNEMAKVDDSFFHRLEESFLVEEDKKHERHPIFGNIVDEVAYHEKYPTIYHLRKKLVDSTDKADLR
LIYLALAHMIKFRGHFLIEGDLNPDNSDVDKLFIQLVQTYNQLFEENPINASGVDAKAILSARLSKSRRLENLIAQ
LPGEKKNGLEGNLIALSLGLIPNEKSNEDLAEDAKLQLSKDTYDDDLDNLLAQIGDQYADLFLAAKNLSDAILLSD
ILRVNTEITKAPLSASMIKRYDEHHQDLTLLKALVRQQLPEKYKEIFFDQSKNGYAGYIDGGASQEEFYKFIKPIL
EKMDGTEELLVKLNREDLLRKQRTFDNGSIPHQIHLGELHAILRRQEDFYPFLKDNREKIEKILTFRIPYYVGPLA
RGNSRFAWMTRKSEETITPWNFEEVVDKGASAQSFIERMTNEDKNLPNEKVLPKHSLLYEYFTVYNELTKVKYVTE
GMRKPAFLSGEQKKAIVDLLFKINRKVIVKQLKEDYFKKIECFDSVEISGVEDRFNASLGTYHDLLKIIKDKDFLD
NEENEDILEDIVLTLTLFEDREMIEERLKTYAHLFDDKVMKQLKRRRYTGWGRLSRKLINGIRDKQSGKTILDFLK
SDGFANRNFMQLIHDDSLTFKEDIQKAQVSGQGDSLHEHIANLAGSPAIKKGILQTVKVVDELVKVMGRHKPENIV
IEMARENQTTQKGQKNSRERMKRIEEGIKELGSQILKEHPVENTQLQNEKLYLYYLQNGRDMYVDQELDINRLSDY
DVDHIVPQSFLKDDSIDNKVLTRSDKNRGKSDNVPSEEVVKKMKNYWRQLLNAKLITQRKEDNLIKAERGGLSELD
KAGFIKRQLVETRQITKHVAQILDSRMNTKYDENDKLIREVKVITLKSKLVSDERKDFQFYKVREINNYHHAHDAY
LNAVVGTALIKKYPKLESEFVYGDYKVYDVRKMIAKSEQEIGKATAKYFFYSNIMNFFKTEITLANGEIRKRPLIE
TNGETGEIVWDKGRDFATVRKVLSMPQVNIVKKTEVQTGGESKESILPKRNSDKLIARKKDWDPKKYGGFDSPTVA
YSVLVVAKVEKGKSKKLKSVKELLGITIMERSSFEKNPIDFLEAKGYKEVKKDLIIKLPKYSLFELENGRKRMLAS
AGELQKGNELALPSKYVNFLYLASHYEKLKGSPEDNEQKQLFVEQHKHYLDEIIEQISEFSKRVILADANLDKVLS
AYNKHRDKPIREQAENIIHLFTLTNLGAPAAFKYFDTTIDRKRYTSTKEVLDATLIHQSITGLYETRIDLSQLGGD
LEAEAAAKEAAAKEAAAKEAAAKALEAEAAAKEAAAKEAAAKEAAAKALE*MVSKGEELFTGVVPILVELDGDVNGH
KFSVSGEGEGDATYGKLTLKFICTTGKLPVPWPTLVTTLTYGVQCFSRYPDHMKQHDFFKSAMPEGYVQERTIFFK
DDGNYKTRAEVKFEGDTLVNRIELKGIDFKEDGNILGHKLEYNYNSHNVYIMADKQKNGIKVNFKIRHNIEDGSVQ
LADHYQQNTPIGDGPVLLPDNHYLSTQSALSKDPNEKRDHMVLLEFVTAAGITLGMDELYK*

SEQ ID NO: 43
MDKKYSIGLDIGINSVGWAVITDEYKVPSKKEKVLGNTDRHSIKKNLIGALLFDSGETAEATRLKRTARRRYTRRK
NRICYLQEIFSNEMAKVDDSFFHRLEESFLVEEDKKHERHPIFGNIVDEVAYHEKYPTIYHLRKKLVDSTDKADLR
LIYLALAHMIKFRGHFLIEGDLNPDNSDVDKLFIQLVQTYNQLFEENPINASGVDAKAILSARLSKSRRLENLIAQ
LPGEKKNGLEGNLIALSLGLIPNEKSNEDLAEDAKLQLSKDTYDDDLDNLLAQIGDQYADLFLAAKNLSDAILLSD
ILRVNTEITKAPLSASMIKRYDEHHQDLTLLKALVRQQLPEKYKEIFFDQSKNGYAGYIDGGASQEEFYKFIKPIL
EKMDGTEELLVKLNREDLLRKQRTFDNGSIPHQIHLGELHAILRRQEDFYPFLKDNREKIEKILTFRIPYYVGPLA
RGNSRFAWMTRKSEETITPWNFEEVVDKGASAQSFIERMTNEDKNLPNEKVLPKHSLLYEYFTVYNELTKVKYVTE
GMRKPAFLSGEQKKAIVDLLFKINRKVIVKQLKEDYFKKIECFDSVEISGVEDRFNASLGTYHDLLKIIKDKDFLD
NEENEDILEDIVLTLTLFEDREMIEERLKTYAHLFDDKVMKQLKRRRYTGWGRLSRKLINGIRDKQSGKTILDFLK
SDGFANRNFMQLIHDDSLTFKEDIQKAQVSGQGDSLHEHIANLAGSPAIKKGILQTVKVVDELVKVMGRHKPENIV
IEMARENQTTQKGQKNSRERMKRIEEGIKELGSQILKEHPVENTQLQNEKLYLYYLQNGRDMYVDQELDINRLSDY
DVDHIVPQSFLKDDSIDNKVLTRSDKNRGKSDNVPSEEVVKKMKNYWRQLLNAKLITQRKEDNLIKAERGGLSELD
KAGFIKRQLVETRQITKHVAQILDSRMNTKYDENDKLIREVKVITLKSKLVSDERKDFQFYKVREINNYHHAHDAY
LNAVVGTALIKKYPKLESEFVYGDYKVYDVRKMIAKSEQEIGKATAKYFFYSNIMNFFKTEITLANGEIRKRPLIE
TNGETGEIVWDKGRDFATVRKVLSMPQVNIVKKTEVQTGGESKESILPKRNSDKLIARKKDWDPKKYGGFDSPTVA
YSVLVVAKVEKGKSKKLKSVKELLGITIMERSSFEKNPIDFLEAKGYKEVKKDLIIKLPKYSLFELENGRKRMLAS
AGELQKGNELALPSKYVNFLYLASHYEKLKGSPEDNEQKQLFVEQHKHYLDEIIEQISEFSKRVILADANLDKVLS
AYNKHRDKPIREQAENIIHLFTLTNLGAPAAFKYFDTTIDRKRYTSTKEVLDATLIHQSITGLYETRIDLSQLGGD
APA*MVSKGEELFTGVVPILVELDGDVNGHKFSVGEGEGDATYGKLTLKFICTTGKLPVPWPTLVTTLTYGVQCFS
RYPDHMKQHDFFKSAMPEGYVQERTIFFKDDGNYKTRAEVKFEGDTLVNRIELKGIDFKEDGNILGHKLEYNYNSH
NVYIMADKQKNGIKVNFKIRHNIEDGSVQLADHYQQNTPIGDGPVLLPDNHYLSTQSALSKDPNEKRDHMVLLEFV
TAAGITLGMDELYK*

SEQ ID NO: 44
MDKKYSIGLDIGINSVGWAVITDEYKVPSKKEKVLGNTDRHSIKKNLIGALLFDSGETAEATRLKRTARRRYTRRK
NRICYLQEIFSNEMAKVDDSFFHRLEESFLVEEDKKHERHPIFGNIVDEVAYHEKYPTIYHLRKKLVDSTDKADLR

TABLE V.1-continued

Cas9-Linker-eGFP Chimeras

LIYLALAHMIKFRGHFLIEGDLNPDNSDVDKLFIQLVQTYNQLFEENPINASGVDAKAILSARLSKSRRLENLIAQ
LPGEKKNGLEGNLIALSLGLIPNEKSNEDLAEDAKLQLSKDTYDDDLDNLLAQIGDQYADLFLAAKNLSDAILLSD
ILRVNTEITKAPLSASMIKRYDEHHQDLTLLKALVRQQLPEKYKEIFFDQSKNGYAGYIDGGASQEEFYKFIKPIL
EKMDGTEELLVKLNREDLLRKQRTFDNGSIPHQIHLGELHAILRRQEDFYPFLKDNREKIEKILTFRIPYYVGPLA
RGNSRFAWMTRKSEETITPWNFEEVVDKGASAQSFIERMTNFDKNLPNEKVLPKHSLLYEYFTVYNELTKVKYTE
GMRKPAFLSGEQKKAIVDLLFKINRKVIVKQLKEDYFKKIECFDSVEISGVEDRFNASLGTYHDLLKIIKDKDFLD
NEENEDILEDIVLTLTLFEDREMIEERLKTYAHLFDDKVMKQLKRRRYTGWGRLSRKLINGIRDKQSGKTILDFLK
SDGFANRNFMQLIHDDSLTFKEDIQKAQVSGQGDSLHEHIANLAGSPAIKKGILQTVKVVDELVKVMGRHKPENIV
IEMARENQTTQKGQKNSRERMKRIEEGIKELGSQILKEHPVENTQLQNEKLYLYYLQNGRDMYVDQELDINRLSDY
DVDHIVPQSFLKDDSIDNKVLTRSDKNRGKSDNVPSEEVVKKMKNYWRQLLNAKLITQRKEDNLIKAERGGLSELD
KAGFIKRQLVETRQITKHVAQILDSRMNTKYDENDKLIREVKVITLKSKLVSDERKDFQFYKVREINNYHHAHDAY
LNAVVGTALIKKYPKLESEFVYGDYKVYDVRKMIAKSEQEIGKATAKYFFYSNIMNFFKTEITLANGEIRKRPLIE
TNGETGEIVWDKGRDFATVRKVLSMPQVNIVKKTEVQTGGFSKESILPKRNSDKLIARKKDWDPKKYGGFDSPTVA
YSVLVVAKVEKGKSKKLKSVKELLGITIMERSSFEKNPIDFLEAKGYKEVKKDLIIKLPKYSLFELENGRKRMLAS
AGELQKGNELALPSKYVNFLYLASHYEKLKGSPEDNEQKQLFVEQHKYLDEIIEQISEFSKRVILADANLDKVLS
AYNKHRDKPIREQAENIIHLFTLTNLINGAPAAFKYFDTTIDRKRYTSKEVLDATLIHQSITGLYETRIDLSQLGGD
APAPA*MVSKGEELFTGVVPILVELDGDVNGHKFSVSGEGEGDATYGKLTLKFICTTGKLPVPWPTLVTTLTYGVQC*
*FSRYPDHMKQHDFFKSAMPEGYVQERTIFFKDDGNYKTRAEVKFEGDTLVNRIELKGIDFKEDGNILGHKLEYNYN*
*SHNVYIMADKQKNGIKVNFKIRHNIEDGSVQLADHYQQNTPIGDGPVLLPDNHYLSTQSALSKDPNEKRDHMVLLE*
*FVTAAGITLGMDELYK*

SEQ ID NO: 45
MDKKYSIGLDIGINSVGWAVITDEYKVPSKKEKVLGNTDRHSIKKNLIGALLFDSGETAEATRLKRTARRRYTRRK
NRICYLQEIFSNEMAKVDDSFFHRLEESFLVEEDKKHERHPIFGNIVDEVAYHEKYPTIYHLRKKLVDSTDKADLR
LIYLALAHMIKFRGHFLIEGDLNPDNSDVDKLFIQLVQTYNQLFEENPINASGVDAKAILSARLSKSRRLENLIAQ
LPGEKKNGLEGNLIALSLGLIPNEKSNEDLAEDAKLQLSKDTYDDDLDNLLAQIGDQYADLFLAAKNLSDAILLSD
ILRVNTEITKAPLSASMIKRYDEHHQDLTLLKALVRQQLPEKYKEIFFDQSKNGYAGYIDGGASQEEFYKFIKPIL
EKMDGTEELLVKLNREDLLRKQRTFDNGSIPHQIHLGELHAILRRQEDFYPFLKDNREKIEKILTFRIPYYVGPLA
RGNSRFAWMTRKSEETITPWNFEEVVDKGASAQSFIERMTNFDKNLPNEKVLPKHSLLYEYFTVYNELTKVKYTE
GMRKPAFLSGEQKKAIVDLLFKINRKVIVKQLKEDYFKKIECFDSVEISGVEDRFNASLGTYHDLLKIIKDKDFLD
NEENEDILEDIVLTLTLFEDREMIEERLKTYAHLFDDKVMKQLKRRRYTGWGRLSRKLINGIRDKQSGKTILDFLK
SDGFANRNFMQLIHDDSLTFKEDIQKAQVSGQGDSLHEHIANLAGSPAIKKGILQTVKVVDELVKVMGRHKPENIV
IEMARENQTTQKGQKNSRERMKRIEEGIKELGSQILKEHPVENTQLQNEKLYLYYLQNGRDMYVDQELDINRLSDY
DVDHIVPQSFLKDDSIDNKVLTRSDKNRGKSDNVPSEEVVKKMKNYWRQLLNAKLITQRKEDNLIKAERGGLSELD
KAGFIKRQLVETRQITKHVAQILDSRMNTKYDENDKLIREVKVITLKSKLVSDERKDFQFYKVREINNYHHAHDAY
LNAVVGTALIKKYPKLESEFVYGDYKVYDVRKMIAKSEQEIGKATAKYFFYSNIMNFFKTEITLANGEIRKRPLIE
TNGETGEIVWDKGRDFATVRKVLSMPQVNIVKKTEVQTGGFSKESILPKRNSDKLIARKKDWDPKKYGGFDSPTVA
YSVLVVAKVEKGKSKKLKSVKELLGITIMERSSFEKNPIDFLEAKGYKEVKKDLIIKLPKYSLFELENGRKRMLAS
AGELQKGNELALPSKYVNFLYLASHYEKLKGSPEDNEQKQLFVEQHKYLDEIIEQISEFSKRVILADANLDKVLS
AYNKHRDKPIREQAENIIHLFTLTNLINGAPAAFKYFDTTIDRKRYTSKEVLDATLIHQSITGLYETRIDLSQLGGD
APAPAPA*MVSKGEELFTGVVPILVELDGDVNGHKFSVSGEGEGDATYGKLTLKFICTTGKLPVPWPTLVTTLTYGV*
*QCFSRYPDHMKQHDFFKSAMPEGYVQERTIFFKDDGNYKTRAEVKFEGDTLVNRIELKGIDFKEDGNILGHKLEYN*
*YNSHNVYIMADKQKNGIKVNFKIRHNIEDGSVQLADHYQQNTPIGDGPVLLPDNHYLSTQSALSKDPNEKRDHMVL*
*LEFVTAAGITLGMDELYK*

SEQ ID NO: 46
MDKKYSIGLDIGINSVGWAVITDEYKVPSKKEKVLGNTDRHSIKKNLIGALLFDSGETAEATRLKRTARRRYTRRK
NRICYLQEIFSNEMAKVDDSFFHRLEESFLVEEDKKHERHPIFGNIVDEVAYHEKYPTIYHLRKKLVDSTDKADLR
LIYLALAHMIKFRGHFLIEGDLNPDNSDVDKLFIQLVQTYNQLFEENPINASGVDAKAILSARLSKSRRLENLIAQ
LPGEKKNGLEGNLIALSLGLIPNEKSNEDLAEDAKLQLSKDTYDDDLDNLLAQIGDQYADLFLAAKNLSDAILLSD
ILRVNTEITKAPLSASMIKRYDEHHQDLTLLKALVRQQLPEKYKEIFFDQSKNGYAGYIDGGASQEEFYKFIKPIL
EKMDGTEELLVKLNREDLLRKQRTFDNGSIPHQIHLGELHAILRRQEDFYPFLKDNREKIEKILTFRIPYYVGPLA
RGNSRFAWMTRKSEETITPWNFEEVVDKGASAQSFIERMTNFDKNLPNEKVLPKHSLLYEYFTVYNELTKVKYTE
GMRKPAFLSGEQKKAIVDLLFKINRKVIVKQLKEDYFKKIECFDSVEISGVEDRFNASLGTYHDLLKIIKDKDFLD
NEENEDILEDIVLTLTLFEDREMIEERLKTYAHLFDDKVMKQLKRRRYTGWGRLSRKLINGIRDKQSGKTILDFLK
SDGFANRNFMQLIHDDSLTFKEDIQKAQVSGQGDSLHEHIANLAGSPAIKKGILQTVKVVDELVKVMGRHKPENIV
IEMARENQTTQKGQKNSRERMKRIEEGIKELGSQILKEHPVENTQLQNEKLYLYYLQNGRDMYVDQELDINRLSDY
DVDHIVPQSFLKDDSIDNKVLTRSDKNRGKSDNVPSEEVVKKMKNYWRQLLNAKLITQRKEDNLIKAERGGLSELD
KAGFIKRQLVETRQITKHVAQILDSRMNTKYDENDKLIREVKVITLKSKLVSDERKDFQFYKVREINNYHHAHDAY
LNAVVGTALIKKYPKLESEFVYGDYKVYDVRKMIAKSEQEIGKATAKYFFYSNIMNFFKTEITLANGEIRKRPLIE
TNGETGEIVWDKGRDFATVRKVLSMPQVNIVKKTEVQTGGFSKESILPKRNSDKLIARKKDWDPKKYGGFDSPTVA
YSVLVVAKVEKGKSKKLKSVKELLGITIMERSSFEKNPIDFLEAKGYKEVKKDLIIKLPKYSLFELENGRKRMLAS
AGELQKGNELALPSKYVNFLYLASHYEKLKGSPEDNEQKQLFVEQHKYLDEIIEQISEFSKRVILADANLDKVLS
AYNKHRDKPIREQAENIIHLFTLTNLINGAPAAFKYFDTTIDRKRYTSKEVLDATLIHQSITGLYETRIDLSQLGGD
APAPAPA*MVSKGEELFTGVVPILVELDGDVNGHKFSVSGEGEGDATYGKLTLKFICTTGKLPVPWPTLVTTLTY*
*GVQCFSRYPDHMKQHDFFKSAMPEGYVQERTIFFKDDGNYKTRAEVKFEGDTLVNRIELKGIDFKEDGNILGHKLE*
*YNYNSHNVYIMADKQKNGIKVNFKIR*HNIEDGSVQLADHYQQNTPIGDGPVLLPDNHYLSTQSALSKDPNEKRDHM
*VLLEFVTAAGITLGMDELYK*

SEQ ID NO: 47
MDKKYSIGLDIGINSVGWAVITDEYKVPSKKEKVLGNTDRHSIKKNLIGALLFDSGETAEATRLKRTARRRYTRRK
NRICYLQEIFSNEMAKVDDSFFHRLEESFLVEEDKKHERHPIFGNIVDEVAYHEKYPTIYHLRKKLVDSTDKADLR
LIYLALAHMIKFRGHFLIEGDLNPDNSDVDKLFIQLVQTYNQLFEENPINASGVDAKAILSARLSKSRRLENLIAQ
LPGEKKNGLEGNLIALSLGLIPNEKSNEDLAEDAKLQLSKDTYDDDLDNLLAQIGDQYADLFLAAKNLSDAILLSD
ILRVNTEITKAPLSASMIKRYDEHHQDLTLLKALVRQQLPEKYKEIFFDQSKNGYAGYIDGGASQEEFYKFIKPIL
EKMDGTEELLVKLNREDLLRKQRTFDNGSIPHQIHLGELHAILRRQEDFYPFLKDNREKIEKILTFRIPYYVGPLA
RGNSRFAWMTRKSEETITPWNFEEVVDKGASAQSFIERMTNFDKNLPNEKVLPKHSLLYEYFTVYNELTKVKYTE
GMRKPAFLSGEQKKAIVDLLFKINRKVIVKQLKEDYFKKIECFDSVEISGVEDRFNASLGTYHDLLKIIKDKDFLD

TABLE V.1-continued

Cas9-Linker-eGFP Chimeras

NEENEDILEDIVLTLTLFEDREMIEERLKTYAHLFDDKVMKQLKRRRYTGWGRLSRKLINGIRDKQSGKTILDFLK
SDGFANRNFMQLIHDDSLTFKEDIQKAQVSGQGDSLHEHIANLAGSPAIKKGILQTVKVVDELVKVMGRHKPENIV
IEMARENQTTQKGQKNSRERMKRIEEGIKELGSQILKEHPVENTQLQNEKLYLYYLQNGRDMYVDQELDINRLSDY
DVDHIVPQSFLKDDSIDNKVLTRSDKNRGKSDNVPSEEVVKKMKNYWRQLLNAKLITQRKEDNLIKAERGGLSELD
KAGFIKRQLVETRQITKHVAQILDSRMNTKYDENDKLIREVKVITLKSKLVSDFRKDFQFYKVREINNYHHAHDAY
LNAVVGTALIKKYPKLESEFVYGDYKVYDVRKMIAKSEQEIGKATAKYFFYSNIMNFFKTEITLANGEIRKRPLIE
TNGETGEIVWDKGRDFATVRKVLSMPQVNIVKKTEVQTGGFSKESILPKRNSDKLIARKKDWDPKKYGGFDSPTVA
YSVLVVAKVEKGKSKKLKSVKELLGITIMERSSFEKNPIDFLEAKGYKEVKKDLIIKLPKYSLFELENGRKRMLAS
AGELQKGNELALPSKYVNFLYLASHYEKLKGSPEDNEQKQLFVEQHKHYLDEIIEQISEFSKRVILADANLDKVLS
AYNKHRDKPIREQAENIIHLFTLINLGAPAAFKYFDTTIDRKRYTSTKEVLDATLIHQSITGLYETRIDLSQLGGD
APAPAPAPAPAPA*MVSKGEELFTGVVPILVELDGDVNGHKFSVSGEGEGDATYGKLTLKFICTTGKLPVPWPTLVTTL
TYGVQCFSRYPDHMKQHDFFKSAMPEGYVQERTIFFKDDGNYKTRAEVKFEGDTLVNRIELKGIDFKEDGNILGHK
LEYNYNSHNVYIMADKQKNGIKVNFKIRHNIEDGSVQLADHYQQNTPIGDGPVLLPDNHYLSTQSALSKDPNEKRD
HMVLLEFVTAAGITLGMDELYK*

SEQ ID NO: 48
MDKKYSIGLDIGTNSVGWAVITDEYKVPSKKFKVLGNTDRHSIKKNLIGALLFDSGETAEATRLKRTARRRYTRRK
NRICYLQEIFSNEMAKVDDSFFHRLEESFLVEEDKKHERHPIFGNIVDEVAYHEKYPTIYHLRKKLVDSTDKADLR
LIYLALAHMIKFRGHFLIEGDLNPDNSDVDKLFIQLVQTYNQLFEENPINASGVDAKAILSARLSKSRRLENLIAQ
LPGEKKNGLEGNLIALSLGLIPNEKSNEDLAEDAKLQLSKDTYDDDLDNLLAQIGDQYADLFLAAKNLSDAILLSD
ILRVNTEITKAPLSASMIKRYDEHHQDLTLLKALVRQQLPEKYKEIFFDQSKNGYAGYIDGGASQEEFYKFIKPIL
EKMDGTEELLVKLNREDLLRKQRTFDNGSIPHQIHLGELHAILRRQEDFYPFLKDNREKIEKILTFRIPYYVGPLA
RGNSRFAWMTRKSEETITPWNFEEVVDKGASAQSFIERMTNFDKNLPNEKVLPKHSLLYEYFTVYNELTKVKYTE
GMRKPAFLSGEQKKAIVDLLFKTINRKVIVKQLKEDYFKKIECFDSVEISGVEDRFNASLGTYHDLLKIIKDKDFLD
NEENEDILEDIVLTLTLFEDREMIEERLKTYAHLFDDKVMKQLKRRRYTGWGRLSRKLINGIRDKQSGKTILDFLK
SDGFANRNFMQLIHDDSLTFKEDIQKAQVSGQGDSLHEHIANLAGSPAIKKGILQTVKVVDELVKVMGRHKPENIV
IEMARENQTTQKGQKNSRERMKRIEEGIKELGSQILKEHPVENTQLQNEKLYLYYLQNGRDMYVDQELDINRLSDY
DVDHIVPQSFLKDDSIDNKVLTRSDKNRGKSDNVPSEEVVKKMKNYWRQLLNAKLITQRKEDNLIKAERGGLSELD
KAGFIKRQLVETRQITKHVAQILDSRMNTKYDENDKLIREVKVITLKSKLVSDFRKDFQFYKVREINNYHHAHDAY
LNAVVGTALIKKYPKLESEFVYGDYKVYDVRKMIAKSEQEIGKATAKYFFYSNIMNFFKTEITLANGEIRKRPLIE
TNGETGEIVWDKGRDFATVRKVLSMPQVNIVKKTEVQTGGFSKESILPKRNSDKLIARKKDWDPKKYGGFDSPTVA
YSVLVVAKVEKGKSKKLKSVKELLGITIMERSSFEKNPIDFLEAKGYKEVKKDLIIKLPKYSLFELENGRKRMLAS
AGELQKGNELALPSKYVNFLYLASHYEKLKGSPEDNEQKQLFVEQHKHYLDEIIEQISEFSKRVILADANLDKVLS
AYNKHRDKPIREQAENIIHLFTLINLGAPAAFKYFDTTIDRKRYTSTKEVLDATLIHQSITGLYETRIDLSQLGGD
APAPAPAPAPAPA*MVSKGEELFTGVVPILVELDGDVNGHKFSVSGEGEGDATYGKLTLKFICTTGKLPVPWPTLVT
TLTYGVQCFSRYPDHMKQHDFFKSAMPEGYVQERTIFFKDDGNYKTRAEVKFEGDTLVNRIELKGIDFKEDGNILG
HKLEYNYNSHNVYIMADKQKNGIKVNFKIRHNIEDGSVQLADHYQQNTPIGDGPVLLPDNHYLSTQSALSKDPNEK
RDHMVLLEFVTAAGITLGMDELYK*

SEQ ID NO: 49
MDKKYSIGLDIGTNSVGWAVITDEYKVPSKKFKVLGNTDRHSIKKNLIGALLFDSGETAEATRLKRTARRRYTRRK
NRICYLQEIFSNEMAKVDDSFFHRLEESFLVEEDKKHERHPIFGNIVDEVAYHEKYPTIYHLRKKLVDSTDKADLR
LIYLALAHMIKFRGHFLIEGDLNPDNSDVDKLFIQLVQTYNQLFEENPINASGVDAKAILSARLSKSRRLENLIAQ
LPGEKKNGLEGNLIALSLGLIPNEKSNEDLAEDAKLQLSKDTYDDDLDNLLAQIGDQYADLFLAAKNLSDAILLSD
ILRVNTEITKAPLSASMIKRYDEHHQDLTLLKALVRQQLPEKYKEIFFDQSKNGYAGYIDGGASQEEFYKFIKPIL
EKMDGTEELLVKLNREDLLRKQRTFDNGSIPHQIHLGELHAILRRQEDFYPFLKDNREKIEKILTFRIPYYVGPLA
RGNSRFAWMTRKSEETITPWNFEEVVDKGASAQSFIERMTNFDKNLPNEKVLPKHSLLYEYFTVYNELTKVKYTE
GMRKPAFLSGEQKKAIVDLLFKTINRKVIVKQLKEDYFKKIECFDSVEISGVEDRFNASLGTYHDLLKIIKDKDFLD
NEENEDILEDIVLTLTLFEDREMIEERLKTYAHLFDDKVMKQLKRRRYTGWGRLSRKLINGIRDKQSGKTILDFLK
SDGFANRNFMQLIHDDSLTFKEDIQKAQVSGQGDSLHEHIANLAGSPAIKKGILQTVKVVDELVKVMGRHKPENIV
IEMARENQTTQKGQKNSRERMKRIEEGIKELGSQILKEHPVENTQLQNEKLYLYYLQNGRDMYVDQELDINRLSDY
DVDHIVPQSFLKDDSIDNKVLTRSDKNRGKSDNVPSEEVVKKMKNYWRQLLNAKLITQRKEDNLIKAERGGLSELD
KAGFIKRQLVETRQITKHVAQILDSRMNTKYDENDKLIREVKVITLKSKLVSDFRKDFQFYKVREINNYHHAHDAY
LNAVVGTALIKKYPKLESEFVYGDYKVYDVRKMIAKSEQEIGKATAKYFFYSNIMNFFKTEITLANGEIRKRPLIE
TNGETGEIVWDKGRDFATVRKVLSMPQVNIVKKTEVQTGGFSKESILPKRNSDKLIARKKDWDPKKYGGFDSPTVA
YSVLVVAKVEKGKSKKLKSVKELLGITIMERSSFEKNPIDFLEAKGYKEVKKDLIIKLPKYSLFELENGRKRMLAS
AGELQKGNELALPSKYVNFLYLASHYEKLKGSPEDNEQKQLFVEQHKHYLDEIIEQISEFSKRVILADANLDKVLS
AYNKHRDKPIREQAENIIHLFTLINLGAPAAFKYFDTTIDRKRYTSTKEVLDATLIHQSITGLYETRIDLSQLGGD
APAPAPAPAPAPA*MVSKGEELFTGVVPILVELDGDVNGHKFSVSGEGEGDATYGKLTLKFICTTGKLPVPWPTL
VTTLTYGVQCFSRYPDHMKQHDFFKSAMPEGYVQERTIFFKDDGNYKTRAEVKFEGDTLVNRIELKGIDFKEDGNI
LGHKLEYNYNSHNVYIMADKQKNGIKVNFKIRHNIEDGSVQLADHYQQNTPIGDGPVLLPDNHYLSTQSALSKDPN
EKRDHMVLLEFVTAAGITLGMDELYK*

SEQ ID NO: 50
MDKKYSIGLDIGTNSVGWAVITDEYKVPSKKFKVLGNTDRHSIKKNLIGALLFDSGETAEATRLKRTARRRYTRRK
NRICYLQEIFSNEMAKVDDSFFHRLEESFLVEEDKKHERHPIFGNIVDEVAYHEKYPTIYHLRKKLVDSTDKADLR
LIYLALAHMIKFRGHFLIEGDLNPDNSDVDKLFIQLVQTYNQLFEENPINASGVDAKAILSARLSKSRRLENLIAQ
LPGEKKNGLEGNLIALSLGLIPNEKSNEDLAEDAKLQLSKDTYDDDLDNLLAQIGDQYADLFLAAKNLSDAILLSD
ILRVNTEITKAPLSASMIKRYDEHHQDLTLLKALVRQQLPEKYKEIFFDQSKNGYAGYIDGGASQEEFYKFIKPIL
EKMDGTEELLVKLNREDLLRKQRTFDNGSIPHQIHLGELHAILRRQEDFYPFLKDNREKIEKILTFRIPYYVGPLA
RGNSRFAWMTRKSEETITPWNFEEVVDKGASAQSFIERMTNFDKNLPNEKVLPKHSLLYEYFTVYNELTKVKYTE
GMRKPAFLSGEQKKAIVDLLFKTINRKVIVKQLKEDYFKKIECFDSVEISGVEDRFNASLGTYHDLLKIIKDKDFLD
NEENEDILEDIVLTLTLFEDREMIEERLKTYAHLFDDKVMKQLKRRRYTGWGRLSRKLINGIRDKQSGKTILDFLK
SDGFANRNFMQLIHDDSLTFKEDIQKAQVSGQGDSLHEHIANLAGSPAIKKGILQTVKVVDELVKVMGRHKPENIV
IEMARENQTTQKGQKNSRERMKRIEEGIKELGSQILKEHPVENTQLQNEKLYLYYLQNGRDMYVDQELDINRLSDY
DVDHIVPQSFLKDDSIDNKVLTRSDKNRGKSDNVPSEEVVKKMKNYWRQLLNAKLITQRKEDNLIKAERGGLSELD
KAGFIKRQLVETRQITKHVAQILDSRMNTKYDENDKLIREVKVITLKSKLVSDFRKDFQFYKVREINNYHHAHDAY
LNAVVGTALIKKYPKLESEFVYGDYKVYDVRKMIAKSEQEIGKATAKYFFYSNIMNFFKTEITLANGEIRKRPLIE

TABLE V.1-continued

Cas9-Linker-eGFP Chimeras

TNGETGEIVWDKGRDFATVRKVLSMPQVNIVKKTEVQTGGESKESILPKRNSDKLIARKKDWDPKKYGGFDSPTVA
YSVLVVAKVEKGKSKKLKSVKELLGITIMERSSFEKNPIDFLEAKGYKEVKKDLIIKLPKYSLFELENGRKRMLAS
AGELQKGNELALPSKYVNFLYLASHYEKLKGSPEDNEQKQLFVEQHKHYLDEIIEQISEFSKRVILADANLDKVLS
AYNKHRDKPIREQAENIIHLFTLTNLGAPAAFKYFDTTIDRKRYTSTKEVLDATLIHQSITGLYETRIDLSQLGGD
APAPAPAPAPAPAPAPA*MVSKGEELFTGVVPILVELDGDVNGHKFSVSGEGEGDATYGKLTLKFICTTGKLPVPWP
TLVTTLTYGVQCFSRYPDHMKQHDFFKSAMPEGYVQERTIFFKDDGNYKTRAEVKFEGDTLVNRIELKGIDFKEDG
NILGHKLEYNYNSHNVYIMADKQKNGIKVNFKIRHNIEDGSVQLADHYQQNTPIGDGPVLLPDNHYLSTQSALSKD
PNEKRDHMVLLEFVTAAGITLGMDELYK*

SEQ ID NO: 51
MDKKYSIGLDIGINSVGWAVITDEYKVPSKKEKVLGNTDRHSIKKNLIGALLFDSGETAEATRLKRTARRRYTRRK
NRICYLQEIFSNEMAKVDDSFFHRLEESFLVEEDKKHERHPIFGNIVDEVAYHEKYPTIYHLRKKLVDSTDKADLR
LIYLALAHMIKFRGHFLIEGDLNPDNSDVDKLFIQLVQTYNQLFEENPINASGVDAKAILSARLSKSRRLENLIAQ
LPGEKKNGLEGNLIALSLGLIPNEKSNEDLAEDAKLQLSKDTYDDDLDNLLAQIGDQYADLFLAAKNLSDAILLSD
ILRVNTEITKAPLSASMIKRYDEHHQDLTLLKALVRQQLPEKYKEIFFDQSKNGYAGYIDGGASQEEFYKFIKPIL
EKMDGTEELLVKLNREDLLRKQRTFDNGSIPHQIHLGELHAILRRQEDFYPFLKDNREKIEKILTFRIPYYVGPLA
RGNSRFAWMTRKSEETITPWNFEEVVDKGASAQSFIERMTNEDKNLPNEKVLPKHSLLYEYFTVYNELTKVKYTE
GMRKPAFLSGEQKKAIVDLLFKINRKVIVKQLKEDYFKKIECFDSVEISGVEDRFNASLGTYHDLLKIIKDKDFLD
NEENEDILEDIVLTLTLFEDREMIEERLKTYAHLFDDKVMKQLKRRRYTGWGRLSRKLINGIRDKQSGKTILDFLK
SDGFANRNFMQLIHDDSLTFKEDIQKAQVSGQGDSLHEHIANLAGSPAIKKGILQTVKVVDELVKVMGRHKPENIV
IEMARENQTTQKGQKNSRERMKRIEEGIKELGSQILKEHPVENTQLQNEKLYLYYLQNGRDMYVDQELDINRLSDY
DVDHIVPQSFLKDDSIDNKVLTRSDKNRGKSDNVPSEEVVKKMKNYWRQLLNAKLITQRKEDNLIKAERGGLSELD
KAGFIKRQLVETRQITKHVAQILDSRMNTKYDENDKLIREVKVITLKSKLVSDERKDFQFYKVREINNYHHAHDAY
LNAVVGTALIKKYPKLESEFVYGDYKVYDVRKMIAKSEQEIGKATAKYFFYSNIMNFFKTEITLANGEIRKRPLIE
TNGETGEIVWDKGRDFATVRKVLSMPQVNIVKKTEVQTGGESKESILPKRNSDKLIARKKDWDPKKYGGFDSPTVA
YSVLVVAKVEKGKSKKLKSVKELLGITIMERSSFEKNPIDFLEAKGYKEVKKDLIIKLPKYSLFELENGRKRMLAS
AGELQKGNELALPSKYVNFLYLASHYEKLKGSPEDNEQKQLFVEQHKHYLDEIIEQISEFSKRVILADANLDKVLS
AYNKHRDKPIREQAENIIHLFTLTNLGAPAAFKYFDTTIDRKRYTSTKEVLDATLIHQSITGLYETRIDLSQLGGD
APAPAPAPAPAPAPAPA*MVSKGEELFTGVVPILVELDGDVNGHKFSVSGEGEGDATYGKLTLKFICTTGKLPVP
WPTLVTTLTYGVQCFSRYPDHMKQHDFFKSAMPEGYVQERTIFFKDDGNYKTRAEVKFEGDTLVNRIELKGIDFKE
DGNILGHKLEYNYNSHNVYIMADKQKNGIKVNFKIRHNIEDGSVQLADHYQQNTPIGDGPVLLPDNHYLSTQSALS
KDPNEDKRDHMVLLEFVTAAGITLGMDELYK*

SEQ ID NO: 52
MDKKYSIGLDIGINSVGWAVITDEYKVPSKKEKVLGNTDRHSIKKNLIGALLFDSGETAEATRLKRTARRRYTRRK
NRICYLQEIFSNEMAKVDDSFFHRLEESFLVEEDKKHERHPIFGNIVDEVAYHEKYPTIYHLRKKLVDSTDKADLR
LIYLALAHMIKFRGHFLIEGDLNPDNSDVDKLFIQLVQTYNQLFEENPINASGVDAKAILSARLSKSRRLENLIAQ
LPGEKKNGLEGNLIALSLGLIPNEKSNEDLAEDAKLQLSKDTYDDDLDNLLAQIGDQYADLFLAAKNLSDAILLSD
ILRVNTEITKAPLSASMIKRYDEHHQDLTLLKALVRQQLPEKYKEIFFDQSKNGYAGYIDGGASQEEFYKFIKPIL
EKMDGTEELLVKLNREDLLRKQRTFDNGSIPHQIHLGELHAILRRQEDFYPFLKDNREKIEKILTFRIPYYVGPLA
RGNSRFAWMTRKSEETITPWNFEEVVDKGASAQSFIERMTNEDKNLPNEKVLPKHSLLYEYFTVYNELTKVKYTE
GMRKPAFLSGEQKKAIVDLLFKINRKVIVKQLKEDYFKKIECFDSVEISGVEDRFNASLGTYHDLLKIIKDKDFLD
NEENEDILEDIVLTLTLFEDREMIEERLKTYAHLFDDKVMKQLKRRRYTGWGRLSRKLINGIRDKQSGKTILDFLK
SDGFANRNFMQLIHDDSLTFKEDIQKAQVSGQGDSLHEHIANLAGSPAIKKGILQTVKVVDELVKVMGRHKPENIV
IEMARENQTTQKGQKNSRERMKRIEEGIKELGSQILKEHPVENTQLQNEKLYLYYLQNGRDMYVDQELDINRLSDY
DVDHIVPQSFLKDDSIDNKVLTRSDKNRGKSDNVPSEEVVKKMKNYWRQLLNAKLITQRKEDNLIKAERGGLSELD
KAGFIKRQLVETRQITKHVAQILDSRMNTKYDENDKLIREVKVITLKSKLVSDERKDFQFYKVREINNYHHAHDAY
LNAVVGTALIKKYPKLESEFVYGDYKVYDVRKMIAKSEQEIGKATAKYFFYSNIMNFFKTEITLANGEIRKRPLIE
TNGETGEIVWDKGRDFATVRKVLSMPQVNIVKKTEVQTGGESKESILPKRNSDKLIARKKDWDPKKYGGFDSPTVA
YSVLVVAKVEKGKSKKLKSVKELLGITIMERSSFEKNPIDFLEAKGYKEVKKDLIIKLPKYSLFELENGRKRMLAS
AGELQKGNELALPSKYVNFLYLASHYEKLKGSPEDNEQKQLFVEQHKHYLDEIIEQISEFSKRVILADANLDKVLS
AYNKHRDKPIREQAENIIHLFTLTNLGAPAAFKYFDTTIDRKRYTSTKEVLDATLIHQSITGLYETRIDLSQLGGD
APAPAPAPAPAPAPAPAPA*MVSKGEELFTGVVPILVELDGDVNGHKFSVSGEFEFDATYGKLTLKFICTTGKLP
VPWPTLVTTLTYGVQCFSRYPDHMKQHDFFKSAMPEGYVQERTIFFKDDGNYKTRAEVKFEGDTLVNRIELKGIDF
KEDGNILGHKLEYNYNSHNVYIMADKQKNGIKVNFKIRHNIEDGSVQLADHYQQNTPIGDGPVLLPDNHYLSTQSA
LSKDPNEKRDHMVLLEFVTAAGITLGMDELYK*

SEQ ID NO: 53
MDKKYSIGLDIGINSVGWAVITDEYKVPSKKEKVLGNTDRHSIKKNLIGALLFDSGETAEATRLKRTARRRYTRRK
NRICYLQEIFSNEMAKVDDSFFHRLEESFLVEEDKKHERHPIFGNIVDEVAYHEKYPTIYHLRKKLVDSTDKADLR
LIYLALAHMIKFRGHFLIEGDLNPDNSDVDKLFIQLVQTYNQLFEENPINASGVDAKAILSARLSKSRRLENLIAQ
LPGEKKNGLEGNLIALSLGLIPNEKSNEDLAEDAKLQLSKDTYDDDLDNLLAQIGDQYADLFLAAKNLSDAILLSD
ILRVNTEITKAPLSASMIKRYDEHHQDLTLLKALVRQQLPEKYKEIFFDQSKNGYAGYIDGGASQEEFYKFIKPIL
EKMDGTEELLVKLNREDLLRKQRTFDNGSIPHQIHLGELHAILRRQEDFYPFLKDNREKIEKILTFRIPYYVGPLA
RGNSRFAWMTRKSEETITPWNFEEVVDKGASAQSFIERMTNEDKNLPNEKVLPKHSLLYEYFTVYNELTKVKYTE
GMRKPAFLSGEQKKAIVDLLFKINRKVIVKQLKEDYFKKIECFDSVEISGVEDRFNASLGTYHDLLKIIKDKDFLD
NEENEDILEDIVLTLTLFEDREMIEERLKTYAHLFDDKVMKQLKRRRYTGWGRLSRKLINGIRDKQSGKTILDFLK
SDGFANRNFMQLIHDDSLTFKEDIQKAQVSGQGDSLHEHIANLAGSPAIKKGILQTVKVVDELVKVMGRHKPENIV
IEMARENQTTQKGQKNSRERMKRIEEGIKELGSQILKEHPVENTQLQNEKLYLYYLQNGRDMYVDQELDINRLSDY
DVDHIVPQSFLKDDSIDNKVLTRSDKNRGKSDNVPSEEVVKKMKNYWRQLLNAKLITQRKEDNLIKAERGGLSELD
KAGFIKRQLVETRQITKHVAQILDSRMNTKYDENDKLIREVKVITLKSKLVSDERKDFQFYKVREINNYHHAHDAY
LNAVVGTALIKKYPKLESEFVYGDYKVYDVRKMIAKSEQEIGKATAKYFFYSNIMNFFKTEITLANGEIRKRPLIE
TNGETGEIVWDKGRDFATVRKVLSMPQVNIVKKTEVQTGGESKESILPKRNSDKLIARKKDWDPKKYGGFDSPTVA
YSVLVVAKVEKGKSKKLKSVKELLGITIMERSSFEKNPIDFLEAKGYKEVKKDLIIKLPKYSLFELENGRKRMLAS
AGELQKGNELALPSKYVNFLYLASHYEKLKGSPEDNEQKQLFVEQHKHYLDEIIEQISEFSKRVILADANLDKVLS
AYNKHRDKPIREQAENIIHLFTLTNLGAPAAFKYFDTTIDRKRYTSTKEVLDATLIHQSITGLYETRIDLSQLGGD
APAPAPAPAPAPAPAPAPAPA*MVSKGEELFTGVVPILVELDGDVNGHKFSVSGEGEGDATYGKLTLKFICTTGK
LPVPWPTLVTTLTYGVQCFSRYPDHMKQHDFFKSAMPEGYVQERTIFFKDDNYKTRAEVKFEGDTLVNRIELKGI*

TABLE V.1-continued

Cas9-Linker-eGFP Chimeras

*DFKEDGNILGHKLEYNYNSHNVYIMADKQKNGIKVNFKIRHNIEDGSVQLADHYQQNTPIGDGPVLLPDNHYLSTQ*
*SALSKDPNEKRDHMVLLEFVTAAGITLGMDELYK*

SEQ ID NO: 54
MDKKYSIGLDIGINSVGWAVITDEYKVPSKKEKVLGNTDRHSIKKNLIGALLFDSGETAEATRLKRTARRRYTRRK
NRICYLQEIFSNEMAKVDDSFFHRLEESFLVEEDKKHERHPIFGNIVDEVAYHEKYPTIYHLRKKLVDSTDKADLR
LIYLALAHMIKFRGHFLIEGDLNPDNSDVDKLFIQLVQTYNQLFEENPINASGVDAKAILSARLSKSRRLENLIAQ
LPGEKKNGLEGNLIALSLGLIPNEKSNEDLAEDAKLQLSKDTYDDDLDNLLAQIGDQYADLFLAAKNLSDAILLSD
ILRVNTEITKAPLSASMIKRYDEHHQDLTLLKALVRQQLPEKYKEIFFDQSKNGYAGYIDGGASQEEFYKFIKPIL
EKMDGTEELLVKLNREDLLRKQRTFDNGSIPHQIHLGELHAILRRQEDFYPFLKDNREKIEKILTFRIPYYVGPLA
RGNSRFAWMTRKSEETITPWNFEEVVDKGASAQSFIERMTNEDKNLPNEKVLPKHSLLYEYFTVYNELTKVKYVTE
GMRKPAFLSGEQKKAIVDLLFKINRKVIVKQLKEDYFKKIECFDSVEISGVEDRFNASLGTYHDLLKIIKDKDFLD
NEENEDILEDIVLTLTLFEDREMIEERLKTYAHLFDDKVMKQLKRRRYTGWGRLSRKLINGIRDKQSGKTILDFLK
SDGFANRNFMQLIHDDSLTFKEDIQKAQVSGQGDSLHEHIANLAGSPAIKKGILQTVKVVDELVKVMGRHKPENIV
IEMARENQTTQKGQKNSRERMKRIEEGIKELGSQILKEHPVENTQLQNEKLYLYYLQNGRDMYVDQELDINRLSDY
DVDHIVPQSFLKDDSIDNKVLTRSDKNRGKSDNVPSEEVVKKMKNYWRQLLNAKLITQRKEDNLIKAERGGLSELD
KAGFIKRQLVETRQITKHVAQILDSRMNTKYDENDKLIREVKVITLKSKLVSDERKDFQFYKVREINNYHHAHDAY
LNAVVGTALIKKYPKLESEFVYGDYKVYDVRKMIAKSEQEIGKATAKYFFYSNIMNFFKTEITLANGEIRKRPLIE
TNGETGEIVWDKGRDFATVRKVLSMPQVNIVKKTEVQTGGESKESILPKRNSDKLIARKKDWDPKKYGGFDSPTVA
YSVLVVAKVEKGKSKKLKSVKELLGITIMERSSFEKNPIDFLEAKGYKEVKKDLIIKLPKYSLFELENGRKRMLAS
AGELQKGNELALPSKYVNFLYLASHYEKLKGSPEDNEQKQLFVEQHKHYLDEIIEQISEFSKRVILADANLDKVLS
AYNKHRDKPIREQAENIIHLFTLINLGAPAAFKYFDTTIDRKRYTSTKEVLDATLIHQSITGLYETRIDLSQLGGD
APAPAPAPAPAPAPAPAPAPAPAPA*MVSKGEELFTGVVPILVELDGDVNGHKFSVSGEGEGDATYGKLTLKFICTT*
*GKLPVPWPTLVTTLTYGVQCFSRYPDHMKQHDFFKSAMPEGYVQERTIFFKDDGNYKTRAEVKFEGDTLVNRIELK*
*GIDFKEDGNILGHKLEYNYNSHNVYIMADKQKNGIKVNFKIRHNIEDGSVQLADHYQQNTPIGDGPVLLPDNHYLS*
*TQSALSKDPNEKRDHMVLLEFVTAAGITLGMDELYK*

SEQ ID NO: 55
MDKKYSIGLDIGINSVGWAVITDEYKVPSKKEKVLGNTDRHSIKKNLIGALLFDSGETAEATRLKRTARRRYTRRK
NRICYLQEIFSNEMAKVDDSFFHRLEESFLVEEDKKHERHPIFGNIVDEVAYHEKYPTIYHLRKKLVDSTDKADLR
LIYLALAHMIKFRGHFLIEGDLNPDNSDVDKLFIQLVQTYNQLFEENPINASGVDAKAILSARLSKSRRLENLIAQ
LPGEKKNGLEGNLIALSLGLIPNEKSNEDLAEDAKLQLSKDTYDDDLDNLLAQIGDQYADLFLAAKNLSDAILLSD
ILRVNTEITKAPLSASMIKRYDEHHQDLTLLKALVRQQLPEKYKEIFFDQSKNGYAGYIDGGASQEEFYKFIKPIL
EKMDGTEELLVKLNREDLLRKQRTFDNGSIPHQIHLGELHAILRRQEDFYPFLKDNREKIEKILTFRIPYYVGPLA
RGNSRFAWMTRKSEETITPWNFEEVVDKGASAQSFIERMTNEDKNLPNEKVLPKHSLLYEYFTVYNELTKVKYVTE
GMRKPAFLSGEQKKAIVDLLFKINRKVIVKQLKEDYFKKIECFDSVEISGVEDRFNASLGTYHDLLKIIKDKDFLD
NEENEDILEDIVLTLTLFEDREMIEERLKTYAHLFDDKVMKQLKRRRYTGWGRLSRKLINGIRDKQSGKTILDFLK
SDGFANRNFMQLIHDDSLTFKEDIQKAQVSGQGDSLHEHIANLAGSPAIKKGILQTVKVVDELVKVMGRHKPENIV
IEMARENQTTQKGQKNSRERMKRIEEGIKELGSQILKEHPVENTQLQNEKLYLYYLQNGRDMYVDQELDINRLSDY
DVDHIVPQSFLKDDSIDNKVLTRSDKNRGKSDNVPSEEVVKKMKNYWRQLLNAKLITQRKEDNLIKAERGGLSELD
KAGFIKRQLVETRQITKHVAQILDSRMNTKYDENDKLIREVKVITLKSKLVSDERKDFQFYKVREINNYHHAHDAY
LNAVVGTALIKKYPKLESEFVYGDYKVYDVRKMIAKSEQEIGKATAKYFFYSNIMNFFKTEITLANGEIRKRPLIE
TNGETGEIVWDKGRDFATVRKVLSMPQVNIVKKTEVQTGGESKESILPKRNSDKLIARKKDWDPKKYGGFDSPTVA
YSVLVVAKVEKGKSKKLKSVKELLGITIMERSSFEKNPIDFLEAKGYKEVKKDLIIKLPKYSLFELENGRKRMLAS
AGELQKGNELALPSKYVNFLYLASHYEKLKGSPEDNEQKQLFVEQHKHYLDEIIEQISEFSKRVILADANLDKVLS
AYNKHRDKPIREQAENIIHLFTLINLGAPAAFKYFDTTIDRKRYTSTKEVLDATLIHQSITGLYETRIDLSQLGGD
APAPAPAPAPAPAPAPAPAPAPAPA*MVSKGEELFTGVVPILVELDGDVNGHKFSVSGEGEGDATYGKLTLKFIC*
*TTGKLPVPWPTLVTTLTYGVQCFSRYPDHMKQHDFFKSAMPEGYVQERTIFFKDDGNYKTRAEVKFEGDTLVNRIE*
*LKGIDFKEDGNILGHKLEYNYNSHNVYIMADKQKNGIKVNFKIRHNIEDGSQLADHYQQNTPIGDGPVLLPDNHY*
*LSTQSALSKDPNEKRDHMVLL*

SEQ ID NO: 56
MDKKYSIGLDIGINSVGWAVITDEYKVPSKKEKVLGNTDRHSIKKNLIGALLFDSGETAEATRLKRTARRRYTRRK
NRICYLQEIFSNEMAKVDDSFFHRLEESFLVEEDKKHERHPIFGNIVDEVAYHEKYPTIYHLRKKLVDSTDKADLR
LIYLALAHMIKFRGHFLIEGDLNPDNSDVDKLFIQLVQTYNQLFEENPINASGVDAKAILSARLSKSRRLENLIAQ
LPGEKKNGLEGNLIALSLGLIPNEKSNEDLAEDAKLQLSKDTYDDDLDNLLAQIGDQYADLFLAAKNLSDAILLSD
ILRVNTEITKAPLSASMIKRYDEHHQDLTLLKALVRQQLPEKYKEIFFDQSKNGYAGYIDGGASQEEFYKFIKPIL
EKMDGTEELLVKLNREDLLRKQRTFDNGSIPHQIHLGELHAILRRQEDFYPFLKDNREKIEKILTFRIPYYVGPLA
RGNSRFAWMTRKSEETITPWNFEEVVDKGASAQSFIERMTNEDKNLPNEKVLPKHSLLYEYFTVYNELTKVKYVTE
GMRKPAFLSGEQKKAIVDLLFKINRKVIVKQLKEDYFKKIECFDSVEISGVEDRFNASLGTYHDLLKIIKDKDFLD
NEENEDILEDIVLTLTLFEDREMIEERLKTYAHLFDDKVMKQLKRRRYTGWGRLSRKLINGIRDKQSGKTILDFLK
SDGFANRNFMQLIHDDSLTFKEDIQKAQVSGQGDSLHEHIANLAGSPAIKKGILQTVKVVDELVKVMGRHKPENIV
IEMARENQTTQKGQKNSRERMKRIEEGIKELGSQILKEHPVENTQLQNEKLYLYYLQNGRDMYVDQELDINRLSDY
DVDHIVPQSFLKDDSIDNKVLTRSDKNRGKSDNVPSEEVVKKMKNYWRQLLNAKLITQRKEDNLIKAERGGLSELD
KAGFIKRQLVETRQITKHVAQILDSRMNTKYDENDKLIREVKVITLKSKLVSDERKDFQFYKVREINNYHHAHDAY
LNAVVGTALIKKYPKLESEFVYGDYKVYDVRKMIAKSEQEIGKATAKYFFYSNIMNFFKTEITLANGEIRKRPLIE
TNGETGEIVWDKGRDFATVRKVLSMPQVNIVKKTEVQTGGESKESILPKRNSDKLIARKKDWDPKKYGGFDSPTVA
YSVLVVAKVEKGKSKKLKSVKELLGITIMERSSFEKNPIDFLEAKGYKEVKKDLIIKLPKYSLFELENGRKRMLAS
AGELQKGNELALPSKYVNFLYLASHYEKLKGSPEDNEQKQLFVEQHKHYLDEIIEQISEFSKRVILADANLDKVLS
AYNKHRDKPIREQAENIIHLFTLINLGAPAAFKYFDTTIDRKRYTSTKEVLDATLIHQSITGLYETRIDLSQLGGD
APAPAPAPAPAPAPAPAPAPAPAPA*MVSKGEELFTGVVPILVELDGDVNGHKFSVSGEGEGDATYGKLTLKF*
*ICTTGKLPVPWPTLVTTLTYGVQCFSRYPDHMKQHDFFKSAMPEGYVQERTIFFKDDGNYKTRAEVKFEGDTLVNR*
*IELKGIDFKEDGNILGHKLEYNYNSHNVYIMADKQKNGIKVNFKIRHNIEDGSVQLADHYQQNTPIGDGPVLLPDN*
*HYLSTQSALSKDPNEKRDHMVLI*EFVTAAGITLGMDELYK

SEQ ID NO: 57
MDKKYSIGLDIGINSVGWAVITDEYKVPSKKEKVLGNTDRHSIKKNLIGALLFDSGETAEATRLKRTARRRYTRRK
NRICYLQEIFSNEMAKVDDSFFHRLEESFLVEEDKKHERHPIFGNIVDEVAYHEKYPTIYHLRKKLVDSTDKADLR

TABLE V.1-continued

Cas9-Linker-eGFP Chimeras

LIYLALAHMIKFRGHFLIEGDLNPDNSDVDKLFIQLVQTYNQLFEENPINASGVDAKAILSARLSKSRRLENLIAQ
LPGEKKNGLEGNLIALSLGLIPNEKSNEDLAEDAKLQLSKDTYDDDLDNLLAQIGDQYADLFLAAKNLSDAILLSD
ILRVNTEITKAPLSASMIKRYDEHHQDLTLLKALVRQQLPEKYKEIFFDQSKNGYAGYIDGGASQEEFYKFIKPIL
EKMDGTEELLVKLNREDLLRKQRTFDNGSIPHQIHLGELHAILRRQEDFYPFLKDNREKIEKILTFRIPYYVGPLA
RGNSRFAWMTRKSEETITPWNFEEVVDKGASAQSFIERMTNFEDKNLPNEKVLPKHSLLYEYFTVYNELTKVKYTE
GMRKPAFLSGEQKKAIVDLLFKINRKVIVKQLKEDYFKKIECFDSVEISGVEDRFNASLGTYHDLLKIIKDKDFLD
NEENEDILEDIVLTLTLFEDREMIEERLKTYAHLFDDKVMKQLKRRRYTGWGRLSRKLINGIRDKQSGKTILDFLK
SDGFANRNFMQLIHDDSLTFKEDIQKAQVSGQGDSLHEHIANLAGSPAIKKGILQTVKVVDELVKVMGRHKPENIV
IEMARENQTTQKGQKNSRERMKRIEEGIKELGSQILKEHPVENTQLQNEKLYLYYLQNGRDMYVDQELDINRLSDY
DVDHIVPQSFLKDDSIDNKVLTRSDKNRGKSDNVPSEEVVKKMKNYWRQLLNAKLITQRKFDNLIKAERGGLSELD
KAGFIKRQLVETRQITKHVAQILDSRMNTKYDENDKLIREVKVITLKSKLVSDERKDFQFYKVREINNYHHAHDAY
LNAVVGTALIKKYPKLESEFVYGDYKVYDVRKMIAKSEQEIGKATAKYFFYSNIMNFFKTEITLANGEIRKRPLIE
TNGETGEIVWDKGRDFATVRKVLSMPQVNIVKKTEVQTGGFSKESILPKRNSDKLIARKKDWDPKKYGGFDSPTVA
YSVLVVAKVEKGKSKKLKSVKELLGITIMERSSFEKNPIDFLEAKGYKEVKKDLIIKLPKYSLFELENGRKRMLAS
AGELQKGNELALPSKYVNFLYLASHYEKLKGSPEDNEQKQLFVEQHKHYLDEIIEQISEFSKRVILADANLDKVLS
AYNKHRDKPIREQAENIIHLFTLINLGAPAAFKYFDTTIDRKRYTSTKEVLDATLIHQSITGLYETRIDLSQLGGD
*MVSKGEELFTGVVPILVELDGDVNGHKFSVSGEGEGDATYGKLTLKFICTTGKLPVPWPTLVTTLTYGVQCFSR*
*YPDHMKQHDFFKSAMPEGYVQERTIFFKDDGNYKTRAEVKFEGDTLVNRIELKGIDFKEDGNILGHKLEYNYNSHN*
*VYIMADKQKNGIKVNFKIRHNIEDGSVQLADHYQQNTPIGDGPVLLPDNHYLSTQSALSKDPNEKRDHMVLLEFVT*
*AAGITLGMDELYK*

SEQ ID NO: 58
MDKKYSIGLDIGTNSVGWAVITDEYKVPSKKEKVLGNTDRHSIKKNLIGALLFDSGETAEATRLKRTARRRYTRRK
NRICYLQEIFSNEMAKVDDSFFHRLEESFLVEEDKKHERHPIFGNIVDEVAYHEKYPTIYHLRKKLVDSTDKADLR
LIYLALAHMIKFRGHFLIEGDLNPDNSDVDKLFIQLVQTYNQLFEENPINASGVDAKAILSARLSKSRRLENLIAQ
LPGEKKNGLEGNLIALSLGLIPNEKSNEDLAEDAKLQLSKDTYDDDLDNLLAQIGDQYADLFLAAKNLSDAILLSD
ILRVNTEITKAPLSASMIKRYDEHHQDLTLLKALVRQQLPEKYKEIFFDQSKNGYAGYIDGGASQEEFYKFIKPIL
EKMDGTEELLVKLNREDLLRKQRTFDNGSIPHQIHLGELHAILRRQEDFYPFLKDNREKIEKILTFRIPYYVGPLA
RGNSRFAWMTRKSEETITPWNFEEVVDKGASAQSFIERMTNFEDKNLPNEKVLPKHSLLYEYFTVYNELTKVKYTE
GMRKPAFLSGEQKKAIVDLLFKINRKVIVKQLKEDYFKKIECFDSVEISGVEDRFNASLGTYHDLLKIIKDKDFLD
NEENEDILEDIVLTLTLFEDREMIEERLKTYAHLFDDKVMKQLKRRRYTGWGRLSRKLINGIRDKQSGKTILDFLK
SDGFANRNFMQLIHDDSLTFKEDIQKAQVSGQGDSLHEHIANLAGSPAIKKGILQTVKVVDELVKVMGRHKPENIV
IEMARENQTTQKGQKNSRERMKRIEEGIKELGSQILKEHPVENTQLQNEKLYLYYLQNGRDMYVDQELDINRLSDY
DVDHIVPQSFLKDDSIDNKVLTRSDKNRGKSDNVPSEEVVKKMKNYWRQLLNAKLITQRKFDNLIKAERGGLSELD
KAGFIKRQLVETRQITKHVAQILDSRMNTKYDENDKLIREVKVITLKSKLVSDERKDFQFYKVREINNYHHAHDAY
LNAVVGTALIKKYPKLESEFVYGDYKVYDVRKMIAKSEQEIGKATAKYFFYSNIMNFFKTEITLANGEIRKRPLIE
TNGETGEIVWDKGRDFATVRKVLSMPQVNIVKKTEVQTGGFSKESILPKRNSDKLIARKKDWDPKKYGGFDSPTVA
YSVLVVAKVEKGKSKKLKSVKELLGITIMERSSFEKNPIDFLEAKGYKEVKKDLIIKLPKYSLFELENGRKRMLAS
AGELQKGNELALPSKYVNFLYLASHYEKLKGSPEDNEQKQLFVEQHKHYLDEIIEQISEFSKRVILADANLDKVLS
AYNKHRDKPIREQAENIIHLFTLINLGAPAAFKYFDTTIDRKRYTSTKEVLDATLIHQSITGLYETRIDLSQLGGD
XPXP*MVSKGEELFTGVVPILVELDGDVNGHKFSVSGEGEGDATYGKLTLKFICTTGKLPVPWPTLVTTLTYGVQCF*
*SRYPDHMKQHDFFKSAMPEGYVQERTIFFKDDGNYKTRAEVKFEGDTLVNRIELKGIDFKEDGNILGHKLEYNYNS*
*HNVYIMADKQKNGIKVNFKIRHNIEDGSVQLADHYQQNTPIGDGPVLLPDNHYLSTQSALSKDPNEKRDHMVLLEF*
*VTAAGITLGMDELYK*

SEQ ID NO: 59
MDKKYSIGLDIGTNSVGWAVITDEYKVPSKKEKVLGNTDRHSIKKNLIGALLFDSGETAEATRLKRTARRRYTRRK
NRICYLQEIFSNEMAKVDDSFFHRLEESFLVEEDKKHERHPIFGNIVDEVAYHEKYPTIYHLRKKLVDSTDKADLR
LIYLALAHMIKFRGHFLIEGDLNPDNSDVDKLFIQLVQTYNQLFEENPINASGVDAKAILSARLSKSRRLENLIAQ
LPGEKKNGLEGNLIALSLGLIPNEKSNEDLAEDAKLQLSKDTYDDDLDNLLAQIGDQYADLFLAAKNLSDAILLSD
ILRVNTEITKAPLSASMIKRYDEHHQDLTLLKALVRQQLPEKYKEIFFDQSKNGYAGYIDGGASQEEFYKFIKPIL
EKMDGTEELLVKLNREDLLRKQRTFDNGSIPHQIHLGELHAILRRQEDFYPFLKDNREKIEKILTFRIPYYVGPLA
RGNSRFAWMTRKSEETITPWNFEEVVDKGASAQSFIERMTNFEDKNLPNEKVLPKHSLLYEYFTVYNELTKVKYTE
GMRKPAFLSGEQKKAIVDLLFKINRKVIVKQLKEDYFKKIECFDSVEISGVEDRFNASLGTYHDLLKIIKDKDFLD
NEENEDILEDIVLTLTLFEDREMIEERLKTYAHLFDDKVMKQLKRRRYTGWGRLSRKLINGIRDKQSGKTILDFLK
SDGFANRNFMQLIHDDSLTFKEDIQKAQVSGQGDSLHEHIANLAGSPAIKKGILQTVKVVDELVKVMGRHKPENIV
IEMARENQTTQKGQKNSRERMKRIEEGIKELGSQILKEHPVENTQLQNEKLYLYYLQNGRDMYVDQELDINRLSDY
DVDHIVPQSFLKDDSIDNKVLTRSDKNRGKSDNVPSEEVVKKMKNYWRQLLNAKLITQRKFDNLIKAERGGLSELD
KAGFIKRQLVETRQITKHVAQILDSRMNTKYDENDKLIREVKVITLKSKLVSDERKDFQFYKVREINNYHHAHDAY
LNAVVGTALIKKYPKLESEFVYGDYKVYDVRKMIAKSEQEIGKATAKYFFYSNIMNFFKTEITLANGEIRKRPLIE
TNGETGEIVWDKGRDFATVRKVLSMPQVNIVKKTEVQTGGFSKESILPKRNSDKLIARKKDWDPKKYGGFDSPTVA
YSVLVVAKVEKGKSKKLKSVKELLGITIMERSSFEKNPIDFLEAKGYKEVKKDLIIKLPKYSLFELENGRKRMLAS
AGELQKGNELALPSKYVNFLYLASHYEKLKGSPEDNEQKQLFVEQHKHYLDEIIEQISEFSKRVILADANLDKVLS
AYNKHRDKPIREQAENIIHLFTLINLGAPAAFKYFDTTIDRKRYTSTKEVLDATLIHQSITGLYETRIDLSQLGGD
XPXPXP*MVSKGEELFTGVVPILVELDGDVNGHKFSVSGEGEGDATYGKLTLKFICTTGKLPVPWPTLVTTLTYGVQ*
*CFSRYPDHMKQHDFFKSAMPEGYVQERTIFFKDDGNYKTRAEVKFEGDTLVNRIELKGIDFKEDGNILGHKLEYNY*
*NSHNVYIMADKQKNGIKVNFKIRHNIEDGSVQLADHYQQNTPIGDGPVLLPDNHYLSTQSALSKDPNEKRDHMVLL*
*EFVTAAGITLGMDELYK*

SEQ ID NO: 60
MDKKYSIGLDIGTNSVGWAVITDEYKVPSKKEKVLGNTDRHSIKKNLIGALLFDSGETAEATRLKRTARRRYTRRK
NRICYLQEIFSNEMAKVDDSFFHRLEESFLVEEDKKHERHPIFGNIVDEVAYHEKYPTIYHLRKKLVDSTDKADLR
LIYLALAHMIKFRGHFLIEGDLNPDNSDVDKLFIQLVQTYNQLFEENPINASGVDAKAILSARLSKSRRLENLIAQ
LPGEKKNGLEGNLIALSLGLIPNEKSNEDLAEDAKLQLSKDTYDDDLDNLLAQIGDQYADLFLAAKNLSDAILLSD
ILRVNTEITKAPLSASMIKRYDEHHQDLTLLKALVRQQLPEKYKEIFFDQSKNGYAGYIDGGASQEEFYKFIKPIL
EKMDGTEELLVKLNREDLLRKQRTFDNGSIPHQIHLGELHAILRRQEDFYPFLKDNREKIEKILTFRIPYYVGPLA
RGNSRFAWMTRKSEETITPWNFEEVVDKGASAQSFIERMTNFEDKNLPNEKVLPKHSLLYEYFTVYNELTKVKYTE
GMRKPAFLSGEQKKAIVDLLFKINRKVIVKQLKEDYFKKIECFDSVEISGVEDRFNASLGTYHDLLKIIKDKDFLD

TABLE V.1-continued

Cas9-Linker-eGFP Chimeras

NEENEDILEDIVLTLTLFEDREMIEERLKTYAHLFDDKVMKQLKRRRYTGWGRLSRKLINGIRDKQSGKTILDFLK
SDGFANRNFMQLIHDDSLTFKEDIQKAQVSGQGDSLHEHIANLAGSPAIKKGILQTVKVVDELVKVMGRHKPENIV
IEMARENQTTQKGQKNSRERMKRIEEGIKELGSQILKEHPVENTQLQNEKLYLYYLQNGRDMYVDQELDINRLSDY
DVDHIVPQSFLKDDSIDNKVLTRSDKNRGKSDNVPSEEVVKKMKNYWRQLLNAKLITQRKEDNLIKAERGGLSELD
KAGFIKRQLVETRQITKHVAQILDSRMNTKYDENDKLIREVKVITLKSKLVSDERKDFQFYKVREINNYHHAHDAY
LNAVVGTALIKKYPKLESEFVYGDYKVYDVRKMIAKSEQEIGKATAKYFFYSNIMNFFKTEITLANGEIRKRPLIE
TNGETGEIVWDKGRDFATVRKVLSMPQVNIVKKTEVQTGGFSKESILPKRNSDKLIARKKDWDPKKYGGFDSPTVA
YSVLVVAKVEKGKSKKLKSVKELLGITIMERSSFEKNPIDFLEAKGYKEVKKDLIIKLPKYSLFELENGRKRMLAS
AGELQKGNELALPSKYVNFLYLASHYEKLKGSPEDNEQKQLFVEQHKHYLDEIIEQISEFSKRVILADANLDKVLS
AYNKHRDKPIREQAENIIHLFTLINLGAPAAFKYFDTTIDRKRYTSTKEVLDATLIHQSITGLYETRIDLSQLGGD
XPXPXPXPMVSKGEELFTGVVPILVELDGDVNGHKFSVSGEGEGDATYGKLTLKFICTTGKLPVPWPTLVTTLTYG
VQCFSRYPDHMKQHDFFKSAMPEGYVQERTIFFKDDGNYKTRAEVKFEGDTLVNRIELKGIDFKEDGNILGHKLEY
NYNSHNVYIMADKQKNGIKVNFKIRHNIEDGSVQLADHYQQNTPIGDGPVLLPDNHYLSTQSALSKDPNEKRDHMV
LLEFVTAAGITLGMDELYK

SEQ ID NO: 61
MDKKYSIGLDIGINSVGWAVITDEYKVPSKKEKVLGNTDRHSIKKNLIGALLFDSGETAEATRLKRTARRRYTRRK
NRICYLQEIFSNEMAKVDDSFFHRLEESFLVEEDKKHERHPIFGNIVDEVAYHEKYPTIYHLRKKLVDSTDKADLR
LIYLALAHMIKFRGHFLIEGDLNPDNSDVDKLFIQLVQTYNQLFEENPINASGVDAKAILSARLSKSRRLENLIAQ
LPGEKKNGLEGNLIALSLGLIPNEKSNEDLAEDAKLQLSKDTYDDDLDNLLAQIGDQYADLFLAAKNLSDAILLSD
ILRVNTEITKAPLSASMIKRYDEHHQDLTLLKALVRQQLPEKYKEIFFDQSKNGYAGYIDGGASQEEFYKFIKPIL
EKMDGTEELLVKLNREDLLRKQRTFDNGSIPHQIHLGELHAILRRQEDFYPFLKDNREKIEKILTFRIPYYVGPLA
RGNSRFAWMTRKSEETITPWNFEEVVDKGASAQSFIERMTNFDKNLPNEKVLPKHSLLYEYFTVYNELTKVKYTE
GMRKPAFLSGEQKKAIVDLLFKINRKVIVKQLKEDYFKKIECFDSVEISGVEDRFNASLGTYHDLLKIIKDKDFLD
NEENEDILEDIVLTLTLFEDREMIEERLKTYAHLFDDKVMKQLKRRRYTGWGRLSRKLINGIRDKQSGKTILDFLK
SDGFANRNFMQLIHDDSLTFKEDIQKAQVSGQGDSLHEHIANLAGSPAIKKGILQTVKVVDELVKVMGRHKPENIV
IEMARENQTTQKGQKNSRERMKRIEEGIKELGSQILKEHPVENTQLQNEKLYLYYLQNGRDMYVDQELDINRLSDY
DVDHIVPQSFLKDDSIDNKVLTRSDKNRGKSDNVPSEEVVKKMKNYWRQLLNAKLITQRKEDNLIKAERGGLSELD
KAGFIKRQLVETRQITKHVAQILDSRMNTKYDENDKLIREVKVITLKSKLVSDERKDFQFYKVREINNYHHAHDAY
LNAVVGTALIKKYPKLESEFVYGDYKVYDVRKMIAKSEQEIGKATAKYFFYSNIMNFFKTEITLANGEIRKRPLIE
TNGETGEIVWDKGRDFATVRKVLSMPQVNIVKKTEVQTGGFSKESILPKRNSDKLIARKKDWDPKKYGGFDSPTVA
YSVLVVAKVEKGKSKKLKSVKELLGITIMERSSFEKNPIDFLEAKGYKEVKKDLIIKLPKYSLFELENGRKRMLAS
AGELQKGNELALPSKYVNFLYLASHYEKLKGSPEDNEQKQLFVEQHKHYLDEIIEQISEFSKRVILADANLDKVLS
AYNKHRDKPIREQAENIIHLFTLINLGAPAAFKYFDTTIDRKRYTSTKEVLDATLIHQSITGLYETRIDLSQLGGD
XPXPXPXPMVSKGEELFTGVVPILVELDGDVNGHKFSVSGEGEGDATYGKLTLKFICTTGKLPVPWPTLVTTLT
YGVQCFSRYPDHMKQHDFFKSAMPEGYVQERTIFFKDDGNYKTRAEVKFEGDTLVNRIELKGIDFKEDGNILGHKL
EYNYNSHNVYIMADKQKNGIKVNFKIRHNIEDGSVQLADHYQQNTPIGDGPVLLPDNHYLSTQSALSKDPNEKRDH
MVLLEFVTAAGITLGMDELYK

SEQ ID NO: 62
MDKKYSIGLDIGINSVGWAVITDEYKVPSKKEKVLGNTDRHSIKKNLIGALLFDSGETAEATRLKRTARRRYTRRK
NRICYLQEIFSNEMAKVDDSFFHRLEESFLVEEDKKHERHPIFGNIVDEVAYHEKYPTIYHLRKKLVDSTDKADLR
LIYLALAHMIKFRGHFLIEGDLNPDNSDVDKLFIQLVQTYNQLFEENPINASGVDAKAILSARLSKSRRLENLIAQ
LPGEKKNGLEGNLIALSLGLIPNEKSNEDLAEDAKLQLSKDTYDDDLDNLLAQIGDQYADLFLAAKNLSDAILLSD
ILRVNTEITKAPLSASMIKRYDEHHQDLTLLKALVRQQLPEKYKEIFFDQSKNGYAGYIDGGASQEEFYKFIKPIL
EKMDGTEELLVKLNREDLLRKQRTFDNGSIPHQIHLGELHAILRRQEDFYPFLKDNREKIEKILTFRIPYYVGPLA
RGNSRFAWMTRKSEETITPWNFEEVVDKGASAQSFIERMTNFDKNLPNEKVLPKHSLLYEYFTVYNELTKVKYTE
GMRKPAFLSGEQKKAIVDLLFKINRKVIVKQLKEDYFKKIECFDSVEISGVEDRFNASLGTYHDLLKIIKDKDFLD
NEENEDILEDIVLTLTLFEDREMIEERLKTYAHLFDDKVMKQLKRRRYTGWGRLSRKLINGIRDKQSGKTILDFLK
SDGFANRNFMQLIHDDSLTFKEDIQKAQVSGQGDSLHEHIANLAGSPAIKKGILQTVKVVDELVKVMGRHKPENIV
IEMARENQTTQKGQKNSRERMKRIEEGIKELGSQILKEHPVENTQLQNEKLYLYYLQNGRDMYVDQELDINRLSDY
DVDHIVPQSFLKDDSIDNKVLTRSDKNRGKSDNVPSEEVVKKMKNYWRQLLNAKLITQRKEDNLIKAERGGLSELD
KAGFIKRQLVETRQITKHVAQILDSRMNTKYDENDKLIREVKVITLKSKLVSDERKDFQFYKVREINNYHHAHDAY
LNAVVGTALIKKYPKLESEFVYGDYKVYDVRKMIAKSEQEIGKATAKYFFYSNIMNFFKTEITLANGEIRKRPLIE
TNGETGEIVWDKGRDFATVRKVLSMPQVNIVKKTEVQTGGFSKESILPKRNSDKLIARKKDWDPKKYGGFDSPTVA
YSVLVVAKVEKGKSKKLKSVKELLGITIMERSSFEKNPIDFLEAKGYKEVKKDLIIKLPKYSLFELENGRKRMLAS
AGELQKGNELALPSKYVNFLYLASHYEKLKGSPEDNEQKQLFVEQHKHYLDEIIEQISEFSKRVILADANLDKVLS
AYNKHRDKPIREQAENIIHLFTLINLGAPAAFKYFDTTIDRKRYTSTKEVLDATLIHQSITGLYETRIDLSQLGGD
XPXPXPXPXPMVSKGEELFTGVVPILVELDGDVNGHKFSVSGEGEGDATYGKLTLKFICTTGKLPVPWPTLVTT
LTYGVQCFSRYPDHMKQHDFFKSAMPEGYVQERTIFFKDDGNYKTRAEVKFEGDTLVNRIELKGIDFKEDGNILGH
KLEYNYNSHNVYIMADKQKNGIKVNFKIRHNIEDGSVQLADHYQQNTPIGDGPVLLPDNHYLSTQSALSKDPNEKR
DHMVLLEFVTAAGITLGMDELYK

SEQ ID NO: 63
MDKKYSIGLDIGINSVGWAVITDEYKVPSKKEKVLGNTDRHSIKKNLIGALLFDSGETAEATRLKRTARRRYTRRK
NRICYLQEIFSNEMAKVDDSFFHRLEESFLVEEDKKHERHPIFGNIVDEVAYHEKYPTIYHLRKKLVDSTDKADLR
LIYLALAHMIKFRGHFLIEGDLNPDNSDVDKLFIQLVQTYNQLFEENPINASGVDAKAILSARLSKSRRLENLIAQ
LPGEKKNGLEGNLIALSLGLIPNEKSNEDLAEDAKLQLSKDTYDDDLDNLLAQIGDQYADLFLAAKNLSDAILLSD
ILRVNTEITKAPLSASMIKRYDEHHQDLTLLKALVRQQLPEKYKEIFFDQSKNGYAGYIDGGASQEEFYKFIKPIL
EKMDGTEELLVKLNREDLLRKQRTFDNGSIPHQIHLGELHAILRRQEDFYPFLKDNREKIEKILTFRIPYYVGPLA
RGNSRFAWMTRKSEETITPWNFEEVVDKGASAQSFIERMTNFDKNLPNEKVLPKHSLLYEYFTVYNELTKVKYTE
GMRKPAFLSGEQKKAIVDLLFKINRKVIVKQLKEDYFKKIECFDSVEISGVEDRFNASLGTYHDLLKIIKDKDFLD
NEENEDILEDIVLTLTLFEDREMIEERLKTYAHLFDDKVMKQLKRRRYTGWGRLSRKLINGIRDKQSGKTILDFLK
SDGFANRNFMQLIHDDSLTFKEDIQKAQVSGQGDSLHEHIANLAGSPAIKKGILQTVKVVDELVKVMGRHKPENIV
IEMARENQTTQKGQKNSRERMKRIEEGIKELGSQILKEHPVENTQLQNEKLYLYYLQNGRDMYVDQELDINRLSDY
DVDHIVPQSFLKDDSIDNKVLTRSDKNRGKSDNVPSEEVVKKMKNYWRQLLNAKLITQRKEDNLIKAERGGLSELD
KAGFIKRQLVETRQITKHVAQILDSRMNTKYDENDKLIREVKVITLKSKLVSDERKDFQFYKVREINNYHHAHDAY
LNAVVGTALIKKYPKLESEFVYGDYKVYDVRKMIAKSEQEIGKATAKYFFYSNIMNFFKTEITLANGEIRKRPLIE

TABLE V.1-continued

Cas9-Linker-eGFP Chimeras

TNGETGEIVWDKGRDFATVRKVLSMPQVNIVKKTEVQTGGESKESILPKRNSDKLIARKKDWDPKKYGGFDSPTVA
YSVLVVAKVEKGKSKKLKSVKELLGITIMERSSFEKNPIDFLEAKGYKEVKKDLIIKLPKYSLFELENGRKRMLAS
AGELQKGNELALPSKYVNFLYLASHYEKLKGSPEDNEQKQLFVEQHKHYLDEIIEQISEFSKRVILADANLDKVLS
AYNKHRDKPIREQAENIIHLFTLTNLGAPAAFKYFDTTIDRKRYTSTKEVLDATLIHQSITGLYETRIDLSQLGGD
XPXPXPXPXPXPXP*MVSKGEELFTGVVPILVELDGDVNGHKFSVSEGDATYGKLTLKFICTTGKLPVPWPTLV*
*TLTYGVQCFSRYPDHMKQHDFFKSAMPEGYVQERTIFFKDDGNYKTRAEVKFEGDTLVNRIELKGIDFKEDGNIL*
*GHKLEYNYNSHNVYIMADKQKNGIKVNFKIRHNIEDGSVQLADHYQQNTPIGDGPVLLPDNHYLSTQSALSKDPNE*
*KRDHMVLLEFVTAAGITLGMDELYK*

SEQ ID NO: 64
MDKKYSIGLDIGINSVGWAVITDEYKVPSKKEKVLGNTDRHSIKKNLIGALLFDSGETAEATRLKRTARRRYTRRK
NRICYLQEIFSNEMAKVDDSFFHRLEESFLVEEDKKHERHPIFGNIVDEVAYHEKYPTIYHLRKKLVDSTDKADLR
LIYLALAHMIKFRGHFLIEGDLNPDNSDVDKLFIQLVQTYNQLFEENPINASGVDAKAILSARLSKSRRLENLIAQ
LPGEKKNGLEGNLIALSLGLIPNEKSNEDLAEDAKLQLSKDTYDDDLDNLLAQIGDQYADLFLAAKNLSDAILLSD
ILRVNTEITKAPLSASMIKRYDEHHQDLTLLKALVRQQLPEKYKEIFFDQSKNGYAGYIDGGASQEEFYKFIKPIL
EKMDGTEELLVKLNREDLLRKQRTFDNGSIPHQIHLGELHAILRRQEDFYPFLKDNREKIEKILTFRIPYYVGPLA
RGNSRFAWMTRKSEETITPWNFEEVVDKGASAQSFIERMTNEDKNLPNEKVLPKHSLLYEYFTVYNELTKVKYTE
GMRKPAFLSGEQKKAIVDLLFKINRKVIVKQLKEDYFKKIECFDSVEISGVEDRFNASLGTYHDLLKIIKDKDFLD
NEENEDILEDIVLTLTLFEDREMIEERLKTYAHLFDDKVMKQLKRRRYTGWGRLSRKLINGIRDKQSGKTILDFLK
SDGFANRNFMQLIHDDSLTFKEDIQKAQVSGQGDSLHEHIANLAGSPAIKKGILQTVKVVDELVKVMGRHKPENIV
IEMARENQTTQKGQKNSRERMKRIEEGIKELGSQILKEHPVENTQLQNEKLYLYYLQNGRDMYVDQELDINRLSDY
DVDHIVPQSFLKDDSIDNKVLTRSDKNRGKSDNVPSEEVVKKMKNYWRQLLNAKLITQRKEDNLIKAERGGLSELD
KAGFIKRQLVETRQITKHVAQILDSRMNTKYDENDKLIREVKVITLKSKLVSDERKDFQFYKVREINNYHHAHDAY
LNAVVGTALIKKYPKLESEFVYGDYKVYDVRKMIAKSEQEIGKATAKYFFYSNIMNFFKTEITLANGEIRKRPLIE
TNGETGEIVWDKGRDFATVRKVLSMPQVNIVKKTEVQTGGESKESILPKRNSDKLIARKKDWDPKKYGGFDSPTVA
YSVLVVAKVEKGKSKKLKSVKELLGITIMERSSFEKNPIDFLEAKGYKEVKKDLIIKLPKYSLFELENGRKRMLAS
AGELQKGNELALPSKYVNFLYLASHYEKLKGSPEDNEQKQLFVEQHKHYLDEIIEQISEFSKRVILADANLDKVLS
AYNKHRDKPIREQAENIIHLFTLTNLGAPAAFKYFDTTIDRKRYTSTKEVLDATLIHQSITGLYETRIDLSQLGGD
XPXPXPXPXPXPXP*MVSKGEELFTGVVPILVELDGDVNGHKFSVSGEGEGDATYGKLTLKFICTTGKLPVPWPT*
*LVTTLTYGVQCFSRYPDHMKQHDFFKSAMEEGYVQERTIFFKDDGNYKTRAEVKFEGDTLVNRIELKGIDFKEDGN*
*ILGHKLEYNYNSHNVYIMADKQKNGIKVNFKIRHNIEDGSVQLADHYQQNTPIGDGPVLLPDNHYLSTQSALSKDP*
*NEKRDHMVLLEFVTAAGITLGMDELYK*

SEQ ID NO: 65
MDKKYSIGLDIGINSVGWAVITDEYKVPSKKEKVLGNTDRHSIKKNLIGALLFDSGETAEATRLKRTARRRYTRRK
NRICYLQEIFSNEMAKVDDSFFHRLEESFLVEEDKKHERHPIFGNIVDEVAYHEKYPTIYHLRKKLVDSTDKADLR
LIYLALAHMIKFRGHFLIEGDLNPDNSDVDKLFIQLVQTYNQLFEENPINASGVDAKAILSARLSKSRRLENLIAQ
LPGEKKNGLEGNLIALSLGLIPNEKSNEDLAEDAKLQLSKDTYDDDLDNLLAQIGDQYADLFLAAKNLSDAILLSD
ILRVNTEITKAPLSASMIKRYDEHHQDLTLLKALVRQQLPEKYKEIFFDQSKNGYAGYIDGGASQEEFYKFIKPIL
EKMDGTEELLVKLNREDLLRKQRTFDNGSIPHQIHLGELHAILRRQEDFYPFLKDNREKIEKILTFRIPYYVGPLA
RGNSRFAWMTRKSEETITPWNFEEVVDKGASAQSFIERMTNEDKNLPNEKVLPKHSLLYEYFTVYNELTKVKYTE
GMRKPAFLSGEQKKAIVDLLFKINRKVIVKQLKEDYFKKIECFDSVEISGVEDRFNASLGTYHDLLKIIKDKDFLD
NEENEDILEDIVLTLTLFEDREMIEERLKTYAHLFDDKVMKQLKRRRYTGWGRLSRKLINGIRDKQSGKTILDFLK
SDGFANRNFMQLIHDDSLTFKEDIQKAQVSGQGDSLHEHIANLAGSPAIKKGILQTVKVVDELVKVMGRHKPENIV
IEMARENQTTQKGQKNSRERMKRIEEGIKELGSQILKEHPVENTQLQNEKLYLYYLQNGRDMYVDQELDINRLSDY
DVDHIVPQSFLKDDSIDNKVLTRSDKNRGKSDNVPSEEVVKKMKNYWRQLLNAKLITQRKEDNLIKAERGGLSELD
KAGFIKRQLVETRQITKHVAQILDSRMNTKYDENDKLIREVKVITLKSKLVSDERKDFQFYKVREINNYHHAHDAY
LNAVVGTALIKKYPKLESEFVYGDYKVYDVRKMIAKSEQEIGKATAKYFFYSNIMNFFKTEITLANGEIRKRPLIE
TNGETGEIVWDKGRDFATVRKVLSMPQVNIVKKTEVQTGGESKESILPKRNSDKLIARKKDWDPKKYGGFDSPTVA
YSVLVVAKVEKGKSKKLKSVKELLGITIMERSSFEKNPIDFLEAKGYKEVKKDLIIKLPKYSLFELENGRKRMLAS
AGELQKGNELALPSKYVNFLYLASHYEKLKGSPEDNEQKQLFVEQHKHYLDEIIEQISEFSKRVILADANLDKVLS
AYNKHRDKPIREQAENIINLFTLTNLGAPAAFKYFDTTIDRKRYTSTKEVLDATLIHQSITGLYETRIDLSQLGGD
XPXPXPXPXPXPXP*MVSKGEELFTGVVPILVELDGDVNGHKFSVSSGEGEGDATYGKLTLKFICTTGKLPVPW*
*PTLVTTLTYGVQCFSRYPDHMKQHDFFKSAMPEGYVQERTIFFKDDGNYKTSAMPEGYVQERTIFFKDDGNYKT*
*GNILGHKLEYNYNSHNVYIMADKQKNGIKVNFKIRHNIEDGSVQLADHYQQNTPIGDGPVLLPDNHYLSTQSALSK*
*DPNEKRDHMVLLEFVTAAGITLGMDELYK*

SEQ ID NO: 66
MDKKYSIGLDIGINSVGWAVITDEYKVPSKKEKVLGNTDRHSIKKNLIGALLFDSGETAEATRLKRTARRRYTRRK
NRICYLQEIFSNEMAKVDDSFFHRLEESFLVEEDKKHERHPIFGNIVDEVAYHEKYPTIYHLRKKLVDSTDKADLR
LIYLALAHMIKFRGHFLIEGDLNPDNSDVDKLFIQLVQTYNQLFEENPINASGVDAKAILSARLSKSRRLENLIAQ
LPGEKKNGLEGNLIALSLGLIPNEKSNEDLAEDAKLQLSKDTYDDDLDNLLAQIGDQYADLFLAAKNLSDAILLSD
ILRVNTEITKAPLSASMIKRYDEHHQDLTLLKALVRQQLPEKYKEIFFDQSKNGYAGYIDGGASQEEFYKFIKPIL
EKMDGTEELLVKLNREDLLRKQRTFDNGSIPHQIHLGELHAILRRQEDFYPFLKDNREKIEKILTFRIPYYVGPLA
RGNSRFAWMTRKSEETITPWNFEEVVDKGASAQSFIERMTNEDKNLPNEKVLPKHSLLYEYFTVYNELTKVKYTE
GMRKPAFLSGEQKKAIVDLLFKINRKVIVKQLKEDYFKKIECFDSVEISGVEDRFNASLGTYHDLLKIIKDKDFLD
NEENEDILEDIVLTLTLFEDREMIEERLKTYAHLFDDKVMKQLKRRRYTGWGRLSRKLINGIRDKQSGKTILDFLK
SDGFANRNFMQLIHDDSLTFKEDIQKAQVSGQGDSLHEHIANLAGSPAIKKGILQTVKVVDELVKVMGRHKPENIV
IEMARENQTTQKGQKNSRERMKRIEEGIKELGSQILKEHPVENTQLQNEKLYLYYLQNGRDMYVDQELDINRLSDY
DVDHIVPQSFLKDDSIDNKVLTRSDKNRGKSDNVPSEEVVKKMKNYWRQLLNAKLITQRKEDNLIKAERGGLSELD
KAGFIKRQLVETRQITKHVAQILDSRMNTKYDENDKLIREVKVITLKSKLVSDERKDFQFYKVREINNYHHAHDAY
LNAVVGTALIKKYPKLESEFVYGDYKVYDVRKMIAKSEQEIGKATAKYFFYSNIMNFFKTEITLANGEIRKRPLIE
TNGETGEIVWDKGRDFATVRKVLSMPQVNIVKKTEVQTGGESKESILPKRNSDKLIARKKDWDPKKYGGFDSPTVA
YSVLVVAKVEKGKSKKLKSVKELLGITIMERSSFEKNPIDFLEAKGYKEVKKDLIIKLPKYSLFELENGRKRMLAS
AGELQKGNELALPSKYVNFLYLASHYEKLKGSPEDNEQKQLFVEQHKHYLDEIIEQISEFSKRVILADANLDKVLS
AYNKHRDKPIREQAENIIHLFTLTNLGAPAAFKYFDTTIDRKRYTSTKEVLDATLIHQSITGLYETRIDLSQLGGD
XPXPXPXPXPXPXPXP*MVSKGEELFTGVVPILVELDGDVNGHKFSVSGEGEGDATYGKLTLKFICTTGKLPV*
*PWPTLVTTLTYGVQCFSRYPDHMKQHDFFKSAMPEGYVQERTIFFKDDGNYKTRAEVKFEGDTLVNRIELKGIDFK*

TABLE V.1-continued

Cas9-Linker-eGFP Chimeras

EDGNILGHKLEYNYNSHNVYIMADKQKNGIKVNFKIRHNIEDGSVQLADHYQQNTPIGDGPVLLPDNHYLSTQSAL
SKDPNEKRDHMVLLEFVTAAGITLGMDELYK

SEQ ID NO: 67
MDKKYSIGLDIGINSVGWAVITDEYKVPSKKEKVLGNTDRHSIKKNLIGALLFDSGETAEATRLKRTARRRYTRRK
NRICYLQEIFSNEMAKVDDSFFHRLEESFLVEEDKKHERHPIFGNIVDEVAYHEKYPTIYHLRKKLVDSTDKADLR
LIYLALAHMIKFRGHFLIEGDLNPDNSDVDKLFIQLVQTYNQLFEENPINASGVDAKAILSARLSKSRRLENLIAQ
LPGEKKNGLEGNLIALSLGLIPNEKSNEDLAEDAKLQLSKDTYDDDLDNLLAQIGDQYADLFLAAKNLSDAILLSD
ILRVNTEITKAPLSASMIKRYDEHHQDLTLLKALVRQQLPEKYKEIFFDQSKNGYAGYIDGGASQEEFYKFIKPIL
EKMDGTEELLVKLNREDLLRKQRTFDNGSIPHQIHLGELHAILRRQEDFYPFLKDNREKIEKILTFRIPYYVGPLA
RGNSRFAWMTRKSEETITPWNFEEVVDKGASAQSFIERMTNEDKNLPNEKVLPKHSLLYEYFTVYNELTKVKYVTE
GMRKPAFLSGEQKKAIVDLLFKINRKVIVKQLKEDYFKKIECFDSVEISGVEDRFNASLGTYHDLLKIIKDKDFLD
NEENEDILEDIVLTLTLFEDREMIEERLKTYAHLFDDKVMKQLRRRYTGWGRLSRKLINGIRDKQSGKTILDFLK
SDGFANRNFMQLIHDDSLTFKEDIQKAQVSGQGDSLHEHIANLAGSPAIKKGILQTVKVVDELVKVMGRHKPENIV
IEMARENQTTQKGQKNSRERMKRIEEGIKELGSQILKEHPVENTQLQNEKLYLYYLQNGRDMYVDQELDINRLSDY
DVDHIVPQSFLKDDSIDNKVLTRSDKNRGKSDNVPSEEVVKKMKNYWRQLLNAKLITQRKEDNLIKAERGGLSELD
KAGFIKRQLVETRQITKHVAQILDSRMNTKYDENDKLIREVKVITLKSKLVSDERKDFQFYKVREINNYHHAHDAY
LNAVVGTALIKKYPKLESEFVYGDYKVYDVRKMIAKSEQEIGKATAKYFFYSNIMNFFKTEITLANGEIRKRPLIE
TNGETGEIVWDKGRDFATVRKVLSMPQVNIVKKTEVQTGGESKESILPKRNSDKLIARKKDWDPKKYGGFDSPTVA
YSVLVVAKVEKGKSKKLKSVKELLGITIMERSSFEKNPIDFLEAKGYKEVKKDLIIKLPKYSLFELENGRKRMLAS
AGELQKGNELALPSKYVNFLYLASHYEKLKGSPEDNEQKQLFVEQHKHYLDEIIEQISEFSKRVILADANLDKVLS
AYNKHRDKPIREQAENIIHLFTLINLGAPAAFKYFDTTIDRKRYTSTKEVLDATLIHQSITGLYETRIDLSQLGGD
XPXPXPXPXPXPXPXPXPXPXP*MVSKGEELFTGVVPILVELDGDVNGHKFSVSGEGEGDATYGKLTLKFICTTGKL
PVPWPTLVTTLTYGVQCFSRYPDHMKQHDFFKSAMPEGYVQERTIFFKDDGNYKTRAEVKFEGDTLVNRIELKGID
FKEDGNILGHKLEYNYNSHNVYIMADKQKNGIKVNFKIRHNIEDGSVQLADHYQQNTPIGDGPVLLPDNHYLSTQS
ALSKDPNEKRDHMVLLEFVTAAGITLGMDELYK*

SEQ ID NO: 68
MDKKYSIGLDIGINSVGWAVITDEYKVPSKKEKVLGNTDRHSIKKNLIGALLFDSGETAEATRLKRTARRRYTRRK
NRICYLQEIFSNEMAKVDDSFFHRLEESFLVEEDKKHERHPIFGNIVDEVAYHEKYPTIYHLRKKLVDSTDKADLR
LIYLALAHMIKFRGHFLIEGDLNPDNSDVDKLFIQLVQTYNQLFEENPINASGVDAKAILSARLSKSRRLENLIAQ
LPGEKKNGLEGNLIALSLGLIPNEKSNEDLAEDAKLQLSKDTYDDDLDNLLAQIGDQYADLFLAAKNLSDAILLSD
ILRVNTEITKAPLSASMIKRYDEHHQDLTLLKALVRQQLPEKYKEIFFDQSKNGYAGYIDGGASQEEFYKFIKPIL
EKMDGTEELLVKLNREDLLRKQRTFDNGSIPHQIHLGELHAILRRQEDFYPFLKDNREKIEKILTFRIPYYVGPLA
RGNSRFAWMTRKSEETITPWNFEEVVDKGASAQSFIERMTNEDKNLPNEKVLPKHSLLYEYFTVYNELTKVKYVTE
GMRKPAFLSGEQKKAIVDLLFKINRKVIVKQLKEDYFKKIECFDSVEISGVEDRFNASLGTYHDLLKIIKDKDFLD
NEENEDILEDIVLTLTLFEDREMIEERLKTYAHLFDDKVMKQLRRRYTGWGRLSRKLINGIRDKQSGKTILDFLK
SDGFANRNFMQLIHDDSLTFKEDIQKAQVSGQGDSLHEHIANLAGSPAIKKGILQTVKVVDELVKVMGRHKPENIV
IEMARENQTTQKGQKNSRERMKRIEEGIKELGSQILKEHPVENTQLQNEKLYLYYLQNGRDMYVDQELDINRLSDY
DVDHIVPQSFLKDDSIDNKVLTRSDKNRGKSDNVPSEEVVKKMKNYWRQLLNAKLITQRKEDNLIKAERGGLSELD
KAGFIKRQLVETRQITKHVAQILDSRMNTKYDENDKLIREVKVITLKSKLVSDERKDFQFYKVREINNYHHAHDAY
LNAVVGTALIKKYPKLESEFVYGDYKVYDVRKMIAKSEQEIGKATAKYFFYSNIMNFFKTEITLANGEIRKRPLIE
TNGETGEIVWDKGRDFATVRKVLSMPQVNIVKKTEVQTGGESKESILPKRNSDKLIARKKDWDPKKYGGFDSPTVA
YSVLVVAKVEKGKSKKLKSVKELLGITIMERSSFEKNPIDFLEAKGYKEVKKDLIIKLPKYSLFELENGRKRMLAS
AGELQKGNELALPSKYVNFLYLASHYEKLKGSPEDNEQKQLFVEQHKHYLDEIIEQISEFSKRVILADANLDKVLS
AYNKHRDKPIREQAENIIHLFTLTNLGAPAAFKYFDTTIDRKRYTSTKEVLDATLIHQSITGLYETRIDLSQLGGD
XPXPXPXPXPXPXPXPXPXP*MVSKGEELFTGVVPILVELDGDVNGHKFSVSGEGEGDATYGKLTLKFICTTG
KLPVPWPTLVTTLTYGVQCFSRYPDHMKQHDFFKSAMPEGYVQERTIFFKDDGNYKTRAEVKFWGDTLVNRIELKG
IDFKEDGNILGHKLEYNYNSHNVYIMADKQKNGIKVNFKIRHNIEDGSVQLADHYQQNTPIGDGPVLLPDNHYLST
QSALSKDPNEKRDHMVLLEFVTAAGITLGMDELYK*

SEQ ID NO: 69
MDKKYSIGLDIGINSVGWAVITDEYKVPSKKEKVLGNTDRHSIKKNLIGALLFDSGETAEATRLKRTARRRYTRRK
NRICYLQEIFSNEMAKVDDSFFHRLEESFLVEEDKKHERHPIFGNIVDEVAYHEKYPTIYHLRKKLVDSTDKADLR
LIYLALAHMIKFRGHFLIEGDLNPDNSDVDKLFIQLVQTYNQLFEENPINASGVDAKAILSARLSKSRRLENLIAQ
LPGEKKNGLEGNLIALSLGLIPNEKSNEDLAEDAKLQLSKDTYDDDLDNLLAQIGDQYADLFLAAKNLSDAILLSD
ILRVNTEITKAPLSASMIKRYDEHHQDLTLLKALVRQQLPEKYKEIFFDQSKNGYAGYIDGGASQEEFYKFIKPIL
EKMDGTEELLVKLNREDLLRKQRTFDNGSIPHQIHLGELHAILRRQEDFYPFLKDNREKIEKILTFRIPYYVGPLA
RGNSRFAWMTRKSEETITPWNFEEVVDKGASAQSFIERMTNEDKNLPNEKVLPKHSLLYEYFTVYNELTKVKYVTE
GMRKPAFLSGEQKKAIVDLLFKINRKVIVKQLKEDYFKKIECFDSVEISGVEDRFNASLGTYHDLLKIIKDKDFLD
NEENEDILEDIVLTLTLFEDREMIEERLKTYAHLFDDKVMKQLRRRYTGWGRLSRKLINGIRDKQSGKTILDFLK
SDGFANRNFMQLIHDDSLTFKEDIQKAQVSGQGDSLHEHIANLAGSPAIKKGILQTVKVVDELVKVMGRHKPENIV
IEMARENQTTQKGQKNSRERMKRIEEGIKELGSQILKEHPVENTQLQNEKLYLYYLQNGRDMYVDQELDINRLSDY
DVDHIVPQSFLKDDSIDNKVLTRSDKNRGKSDNVPSEEVVKKMKNYWRQLLNAKLITQRKEDNLIKAERGGLSELD
KAGFIKRQLVETRQITKHVAQILDSRMNTKYDENDKLIREVKVITLKSKLVSDERKDFQFYKVREINNYHHAHDAY
LNAVVGTALIKKYPKLESEFVYGDYKVYDVRKMIAKSEQEIGKATAKYFFYSNIMNFFKTEITLANGEIRKRPLIE
TNGETGEIVWDKGRDFATVRKVLSMPQVNIVKKTEVQTGGESKESILPKRNSDKLIARKKDWDPKKYGGFDSPTVA
YSVLVVAKVEKGKSKKLKSVKELLGITIMERSSFEKNPIDFLEAKGYKEVKKDLIIKLPKYSLFELENGRKRMLAS
AGELQKGNELALPSKYVNFLYLASHYEKLKGSPEDNEQKQLFVEQHKHYLDEIIEQISEFSKRVILADANLDKVLS
AYNKHRDKPIREQAENIIHLFTLTNLGAPAAFKYFDTTIDRKRYTSTKEVLDATLIHQSITGLYETRIDLSQLGGD
XPXPXPXPXPXPXPXPXPXPXP*MVSKGEELFTGVVPILVELDGDVNGHKFSVSGEGEGDATYGKLTLKFICT
TGKLPVPWPTLVTTLTYGVQCFSRYPDHMKQHDFFKSAMPEGYVQERTIFFKDDGNYKTRAEVKFEGDTLVNRIEL
KGIDFKEDGNILGHKLEYNYNSHNVYIMADKQKNGIKVNFKIRHNIEDGSVQLADHYQQNTPIGDGPVLLPDNHYL
STQSALSKDPNEKRDHMVLLEFVTAAGITLGMDELYK*

SEQ ID NO: 70
MDKKYSIGLDIGINSVGWAVITDEYKVPSKKEKVLGNTDRHSIKKNLIGALLFDSGETAEATRLKRTARRRYTRRK
NRICYLQEIFSNEMAKVDDSFFHRLEESFLVEEDKKHERHPIFGNIVDEVAYHEKYPTIYHLRKKLVDSTDKADLR

TABLE V.1-continued

Cas9-Linker-eGFP Chimeras

```
LIYLALAHMIKFRGHFLIEGDLNPDNSDVDKLFIQLVQTYNQLFEENPINASGVDAKAILSARLSKSRRLENLIAQ
LPGEKKNGLEGNLIALSLGLIPNEKSNEDLAEDAKLQLSKDTYDDDLDNLLAQIGDQYADLFLAAKNLSDAILLSD
ILRVNTEITKAPLSASMIKRYDEHHQDLTLLKALVRQQLPEKYKEIFFDQSKNGYAGYIDGGASQEEFYKFIKPIL
EKMDGTEELLVKLNREDLLRKQRTFDNGSIPHQIHLGELHAILRRQEDFYPFLKDNREKIEKILTFRIPYYVGPLA
RGNSRFAWMTRKSEETITPWNFEEVVDKGASAQSFIERMTNEDKNLPNEKVLPKHSLLYEYFTVYNELTKVKYTE
GMRKPAFLSGEQKKAIVDLLFKINRKVIVKQLKEDYFKKIECFDSVEISGVEDRFNASLGTYHDLLKIIKDKDFLD
NEENEDILEDIVLTLTLFEDREMIEERLKTYAHLFDDKVMKQLKRRRYTGWGRLSRKLINGIRDKQSGKTILDFLK
SDGFANRNFMQLIHDDSLTFKEDIQKAQVSGQGDSLHEHIANLAGSPAIKKGILQTVKVVDELVKVMGRHKPENIV
IEMARENQTTQKGQKNSRERMKRIEEGIKELGSQILKEHPVENTQLQNEKLYLYYLQNGRDMYVDQELDINRLSDY
DVDHIVPQSFLKDDSIDNKVLTRSDKNRGKSDNVPSEEVVKKMKNYWRQLLNAKLITQRKEDNLIKAERGGLSELD
KAGFIKRQLVETRQITKHVAQILDSRMNTKYDENDKLIREVKVITLKSKLVSDERKDFQFYKVREINNYHHAHDAY
LNAVVGTALIKKYPKLESEFVYGDYKVYDVRKMIAKSEQEIGKATAKYFFYSNIMNFFKTEITLANGEIRKRPLIE
TNGETGEIVWDKGRDFATVRKVLSMPQVNIVKKTEVQTGGFSKESILPKRNSDKLIARKKDWDPKKYGGFDSPTVA
YSVLVVAKVEKGKSKKLKSVKELLGITIMERSSFEKNPIDFLEAKGYKEVKKDLIIKLPKYSLFELENGRKRMLAS
AGELQKGNELALPSKYVNFLYLASHYEKLKGSPEDNEQKQLFVEQHKYLDEIIEQISEFSKRVILADANLDKVLS
AYNKHRDKPIREQAENIIHLFTLINLGAPAAFKYFDTTIDRKRYTSTKEVLDATLIHQSITGLYETRIDLSQLGGD
XPXPXPXPXPXPXPXPXPXPXPXPXPMVSKGEELFTGVVPILVELDGDVNGHKFSVSGEGEGDATYGKLTLKFI
CTTGKLPVPWPTLVTTLTYGVQCFSRYPDHMKQHDFFKSAMPEGYVQERTIFFKDDGNYKTRAEVKFEGDTLVNRI
ELKGIDFKEDGNILGHKLEYNYNSHNVYIMADKQKNGIKVNFKIRHNIEDGSVQLADHYQQNTPIGDGPVLLPDNH
YLSTQSALSKDPNEKRDHMVLLEFVTAAGITLGMDELYK

SEQ ID NO: 71
MDKKYSIGLDIGINSVGWAVITDEYKVPSKKEKVLGNTDRHSIKKNLIGALLFDSGETAEATRLKRTARRRYTRRK
NRICYLQEIFSNEMAKVDDSFFHRLEESFLVEEDKKHERHPIFGNIVDEVAYHEKYPTIYHLRKKLVDSTDKADLR
LIYLALAHMIKFRGHFLIEGDLNPDNSDVDKLFIQLVQTYNQLFEENPINASGVDAKAILSARLSKSRRLENLIAQ
LPGEKKNGLEGNLIALSLGLIPNEKSNEDLAEDAKLQLSKDTYDDDLDNLLAQIGDQYADLFLAAKNLSDAILLSD
ILRVNTEITKAPLSASMIKRYDEHHQDLTLLKALVRQQLPEKYKEIFFDQSKNGYAGYIDGGASQEEFYKFIKPIL
EKMDGTEELLVKLNREDLLRKQRTFDNGSIPHQIHLGELHAILRRQEDFYPFLKDNREKIEKILTFRIPYYVGPLA
RGNSRFAWMTRKSEETITPWNFEEVVDKGASAQSFIERMTNEDKNLPNEKVLPKHSLLYEYFTVYNELTKVKYTE
GMRKPAFLSGEQKKAIVDLLFKINRKVIVKQLKEDYFKKIECFDSVEISGVEDRFNASLGTYHDLLKIIKDKDFLD
NEENEDILEDIVLTLTLFEDREMIEERLKTYAHLFDDKVMKQLKRRRYTGWGRLSRKLINGIRDKQSGKTILDFLK
SDGFANRNFMQLIHDDSLTFKEDIQKAQVSGQGDSLHEHIANLAGSPAIKKGILQTVKVVDELVKVMGRHKPENIV
IEMARENQTTQKGQKNSRERMKRIEEGIKELGSQILKEHPVENTQLQNEKLYLYYLQNGRDMYVDQELDINRLSDY
DVDHIVPQSFLKDDSIDNKVLTRSDKNRGKSDNVPSEEVVKKMKNYWRQLLNAKLITQRKEDNLIKAERGGLSELD
KAGFIKRQLVETRQITKHVAQILDSRMNTKYDENDKLIREVKVITLKSKLVSDERKDFQFYKVREINNYHHAHDAY
LNAVVGTALIKKYPKLESEFVYGDYKVYDVRKMIAKSEQEIGKATAKYFFYSNIMNFFKTEITLANGEIRKRPLIE
TNGETGEIVWDKGRDFATVRKVLSMPQVNIVKKTEVQTGGESKESILPKRNSDKLIARKKDWDPKKYGGFDSPTVA
YSVLVVAKVEKGKSKKLKSVKELLGITIMERSSFEKNPIDFLEAKGYKEVKKDLIIKLPKYSLFELENGRKRMLAS
AGELQKGNELALPSKYVNFLYLASHYEKLKGSPEDNEQKQLFVEQHKYLDEIIEQISEFSKRVILADANLDKVLS
AYNKHRDKPIREQAENIIHLFTLINLGAPAAFKYFDTTIDRKRYTSTKEVLDATLIHQSITGLYETRIDLSQLGGD
GGGGSEAAAKGGGGSMVSKGEELFTGVVPILVELDGDVNGHKFSVSGEGEGDATYGKLTLKFICTTGKLPVPWPTL
VTTLTYGVQCFSRYPDHMKQHDFFKSAMPEGYVQERTIFFKDDGNYKTRAEVKFEGDTLVNRIELKGIDFKEDGNI
LGHKLEYNYNSHNVYIMADKQKNGIKVNFKIRHNIEDGSVQLADHYQQNTPIGDGPVLLPDNHYLSTQSALSKDPN
EKRDHMVLLEFVTAAGITLGMDELYK
```

Table V.2 provides chimera fusion proteins between Cas9 amino acid sequences, linker amino acid sequences (underlined), and mCherry amino acid sequences (bolded, italicized).

TABLE V.2

Cas9-Linker-mCherryChimeras

```
SEQ ID NO: 72
MDKKYSIGLDIGTNSVGWAVITDEYKVPSKKFKVLGNTDRHSIKKNLIGALLFDSGETAEATRLKRTARRRYTRRK
NRICYLQEIFSNEMAKVDDSFFHRLEESFLVEEDKKHERHPIFGNIVDEVAYHEKYPTIYHLRKKLVDSTDKADLR
LIYLALAHMIKFRGHFLIEGDLNPDNSDVDKLFIQLVQTYNQLFEENPINASGVDAKAILSARLSKSRRLENLIAQ
LPGEKKNGLFGNLIALSLGLTPNFKSNFDLAEDAKLQLSKDTYDDDLDNLLAQIGDQYADLFLAAKNLSDAILLSD
ILRVNTEITKAPLSASMIKRYDEHHQDLTLLKALVRQQLPEKYKEIFFDQSKNGYAGYIDGGASQEEFYKFIKPIL
EKMDGTEELLVKLNREDLLRKQRTFDNGSIPHQIHLGELHAILRRQEDFYPFLKDNREKIEKILTFRIPYYVGPLA
RGNSRFAWMTRKSEETITPWNFEEVVDKGASAQSFIERMTNFDKNLPNEKVLPKHSLLYEYFTVYNELTKVKYTE
GMRKPAFLSGEQKKAIVDLLFKTNRKVTVKQLKEDYFKKIECFDSVEISGVEDRFNASLGTYHDLLKIIKDKDFLD
NEENEDILEDIVLTLTLFEDREMIEERLKTYAHLFDDKVMKQLKRRRYTGWGRLSRKLINGIRDKQSGKTILDFLK
SDGFANRNFMQLIHDDSLTFKEDIQKAQVSGQGDSLHEHIANLAGSPAIKKGILQTVKVVDELVKVMGRHKPENIV
IEMARENQTTQKGQKNSRERMKRIEEGIKELGSQILKEHPVENTQLQNEKLYLYYLQNGRDMYVDQELDINRLSDY
DVDHIVPQSFLKDDSIDNKVLTRSDKNRGKSDNVPSEEVVKKMKNYWRQLLNAKLITQRKFDNLTKAERGGLSELD
KAGFIKRQLVETRQITKHVAQILDSRMNTKYDENDKLIREVKVITLKSKLVSDFRKDFQFYKVREINNYHHAHDAY
LNAVVGTALIKKYPKLESEFVYGDYKVYDVRKMIAKSEQEIGKATAKYFFYSNIMNFFKTEITLANGEIRKRPLIE
TNGETGEIVWDKGRDFATVRKVLSMPQVNIVKKTEVQTGGFSKESILPKRNSDKLIARKKDWDPKKYGGFDSPTVA
YSVLVVAKVEKGKSKKLKSVKELLGITIMERSSFEKNPIDFLEAKGYKEVKKDLIIKLPKYSLFELENGRKRMLAS
AGELQKGNELALPSKYVNFLYLASHYEKLKGSPEDNEQKQLFVEQHKYLDEIIEQISEFSKRVILADANLDKVLS
AYNKHRDKPIREQAENIIHLFTLINLGAPAAFKYFDTTIDRKRYTSTKEVLDATLIHQSITGLYETRIDLSQLGGD
GSAGSAAGSGEFMVSKGEEDNMAIIKEFMRFKVHMEGSVNGHEFEIEGEGEGRPYEGTQTAKLKVTKGGPLPFAWD
ILSPQFMYGSKAYVKHPADIPDYLKLSFPEGFKWERVMNFEDGGVVTVTQDSSLQDGEFIYKVKLRGTNFPSDGPV
```

TABLE V.2-continued

Cas9-Linker-mCherryChimeras

*MQKKTMGWEASSERMYPEDGALKGEIKQRLKLKDGGHYDAEVKTTYKAKKPVQLPGAYNVNIKLDITSHNEDYTIV*
*EQYERAEGRHSTGGMDELYK*

SEQ ID NO: 73
MDKKYSIGLDIGTNSVGWAVITDEYKVPSKKFKVLGNTDRHSIKKNLIGALLFDSGETAEATRLKRTARRRYTRRK
NRICYLQEIFSNEMAKVDDSFFHRLEESFLVEEDKKHERHPIFGNIVDEVAYHEKYPTIYHLRKKLVDSTDKADLR
LIYLALAHMIKFRGHFLIEGDLNPDNSDVDKLFIQLVQTYNQLFEENPINASGVDAKAILSARLSKSRRLENLIAQ
LPGEKKNGLFGNLIALSLGLTPNFKSNFDLAEDAKLQLSKDTYDDDLDNLLAQIGDQYADLFLAAKNLSDAILLSD
ILRVNTEITKAPLSASMIKRYDEHHQDLTLLKALVRQQLPEKYKEIFFDQSKNGYAGYIDGGASQEEFYKFIKPIL
EKMDGTEELLVKLNREDLLRKQRTFDNGSIPHQIHLGELHAILRRQEDFYPFLKDNREKIEKILTFRIPYYVGPLA
RGNSRFAWMTRKSEETITPWNFEEVVDKGASAQSFIERMTNFDKNLPNEKVLPKHSLLYEYFTVYNELTKVKYVTE
GMRKPAFLSGEQKKAIVDLLFKTNRKVTVKQLKEDYFKKIECFDSVEISGVEDRFNASLGTYHDLLKIIKDKDFLD
NEENEDILEDIVLTLTLFEDREMIEERLKTYAHLFDDKVMKQLKRRRYTGWGRLSRKLINGIRDKQSGKTILDFLK
SDGFANRNFMQLIHDDSLTFKEDIQKAQVSGQGDSLHEHIANLAGSPAIKKGILQTVKVVDELVKVMGRHKPENIV
IEMARENQTTQKGQKNSRERMKRIEEGIKELGSQILKEHPVENTQLQNEKLYLYYLQNGRDMYVDQELDINRLSDY
DVDHIVPQSFLKDDSIDNKVLTRSDKNRGKSDNVPSEEVVKKMKNYWRQLLNAKLITQRKFDNLTKAERGGLSELD
KAGFIKRQLVETRQITKHVAQILDSRMNTKYDENDKLIREVKVITLKSKLVSDFRKDFQFYKVREINNYHHAHDAY
LNAVVGTALIKKYPKLESEFVYGDYKVYDVRKMIAKSEQEIGKATAKYFFYSNIMNFFKTEITLANGEIRKRPLIE
TNGETGEIVWDKGRDFATVRKVLSMPQVNIVKKTEVQTGGFSKESILPKRNSDKLIARKKDWDPKKYGGFDSPTVA
YSVLVVAKVEGKSKKLKSVKELLGITIMERSSFEKNPIDFLEAKGYKEVKKDLIIKLPKYSLFELENGRKRMLAS
AGELQKGNELALPSKYVNFLYLASHYEKLKGSPEDNEQKQLFVEQHKHYLDEIIEQISEFSKRVILADANLDKVLS
AYNKHRDKPIREQAENIIHLFTLTNLGAPAAFKYFDTTIDRKRYTSTKEVLDATLIHQSITGLYETRIDLSQLGGD
GGGSGGGGSGGGGSGGGGS*MVSKGEEDNMAIIKEFMRFKVHMEGSVNGHEFEIEGEGEGRPYEGTQTAKLKVTKG*
*GPLPFAWDILSPQFMYGSKAYVKHPADIPDYLKLSFPEGFKWERVMNFEDGGVVTVTQDSSLQDGEFIYKVKLRGT*
*NFPSDGPVMQKKTMGWEASSERMYPEDGAIKGEIKQRLKLKDGGHYDAEVKTTYKAKKPVQLPGAYNVNIKLDITS*
*HNEDYTIVEQYERAEGRHSTGGMDELYK*

SEQ ID NO: 74
MDKKYSIGLDIGTNSVGWAVITDEYKVPSKKFKVLGNTDRHSIKKNLIGALLFDSGETAEATRLKRTARRRYTRRK
NRICYLQEIFSNEMAKVDDSFFHRLEESFLVEEDKKHERHPIFGNIVDEVAYHEKYPTIYHLRKKLVDSTDKADLR
LIYLALAHMIKFRGHFLIEGDLNPDNSDVDKLFIQLVQTYNQLFEENPINASGVDAKAILSARLSKSRRLENLIAQ
LPGEKKNGLFGNLIALSLGLTPNFKSNFDLAEDAKLQLSKDTYDDDLDNLLAQIGDQYADLFLAAKNLSDAILLSD
ILRVNTEITKAPLSASMIKRYDEHHQDLTLLKALVRQQLPEKYKEIFFDQSKNGYAGYIDGGASQEEFYKFIKPIL
EKMDGTEELLVKLNREDLLRKQRTFDNGSIPHQIHLGELHAILRRQEDFYPFLKDNREKIEKILTFRIPYYVGPLA
RGNSRFAWMTRKSEETITPWNFEEVVDKGASAQSFIERMTNFDKNLPNEKVLPKHSLLYEYFTVYNELTKVKYVTE
GMRKPAFLSGEQKKAIVDLLFKTNRKVTVKQLKEDYFKKIECFDSVEISGVEDRFNASLGTYHDLLKIIKDKDFLD
NEENEDILEDIVLTLTLFEDREMIEERLKTYAHLFDDKVMKQLKRRRYTGWGRLSRKLINGIRDKQSGKTILDFLK
SDGFANRNFMQLIHDDSLTFKEDIQKAQVSGQGDSLHEHIANLAGSPAIKKGILQTVKVVDELVKVMGRHKPENIV
IEMARENQTTQKGQKNSRERMKRIEEGIKELGSQILKEHPVENTQLQNEKLYLYYLQNGRDMYVDQELDINRLSDY
DVDHIVPQSFLKDDSIDNKVLTRSDKNRGKSDNVPSEEVVKKMKNYWRQLLNAKLITQRKFDNLTKAERGGLSELD
KAGFIKRQLVETRQITKHVAQILDSRMNTKYDENDKLIREVKVITLKSKLVSDFRKDFQFYKVREINNYHHAHDAY
LNAVVGTALIKKYPKLESEFVYGDYKVYDVRKMIAKSEQEIGKATAKYFFYSNIMNFFKTEITLANGEIRKRPLIE
TNGETGEIVWDKGRDFATVRKVLSMPQVNIVKKTEVQTGGFSKESILPKRNSDKLIARKKDWDPKKYGGFDSPTVA
YSVLVVAKVEGKSKKLKSVKELLGITIMERSSFEKNPIDFLEAKGYKEVKKDLIIKLPKYSLFELENGRKRMLAS
AGELQKGNELALPSKYVNFLYLASHYEKLKGSPEDNEQKQLFVEQHKHYLDEIIEQISEFSKRVILADANLDKVLS
AYNKHRDKPIREQAENIIHLFTLTNLGAPAAFKYFDTTIDRKRYTSTKEVLDATLIHQSITGLYETRIDLSQLGGD
AEAAAKEAAAKEAAAKEAAAKA*MVSKGEEDNMAIIKEFMRFKVHMEGSVNGHEFEIEGEGEGRPYEGTQTAKLKVT*
*KGGPLPFAWDILSPQFMYGSKAYVKHPADIPDYLKLSFPEGFKWERVMNFEDGGVVTVTQDSSLQDGEFIYKVKLR*
*GTNFPSDGPVMQKKTMGWEASSERMYPEDGALKGEIKQRLKLKDGGHYDAEVKTTYKAKKPVQLPGAYNVNIKLDI*
*TSHNEDYTIVEQYERAEGRHSTGGMDELYK*

SEQ ID NO: 75
MDKKYSIGLDIGTNSVGWAVITDEYKVPSKKFKVLGNTDRHSIKKNLIGALLFDSGETAEATRLKRTARRRYTRRK
NRICYLQEIFSNEMAKVDDSFFHRLEESFLVEEDKKHERHPIFGNIVDEVAYHEKYPTIYHLRKKLVDSTDKADLR
LIYLALAHMIKFRGHFLIEGDLNPDNSDVDKLFIQLVQTYNQLFEENPINASGVDAKAILSARLSKSRRLENLIAQ
LPGEKKNGLFGNLIALSLGLTPNFKSNFDLAEDAKLQLSKDTYDDDLDNLLAQIGDQYADLFLAAKNLSDAILLSD
ILRVNTEITKAPLSASMIKRYDEHHQDLTLLKALVRQQLPEKYKEIFFDQSKNGYAGYIDGGASQEEFYKFIKPIL
EKMDGTEELLVKLNREDLLRKQRTFDNGSIPHQIHLGELHAILRRQEDFYPFLKDNREKIEKILTFRIPYYVGPLA
RGNSRFAWMTRKSEETITPWNFEEVVDKGASAQSFIERMTNFDKNLPNEKVLPKHSLLYEYFTVYNELTKVKYVTE
GMRKPAFLSGEQKKAIVDLLFKTNRKVTVKQLKEDYFKKIECFDSVEISGVEDRFNASLGTYHDLLKIIKDKDFLD
NEENEDILEDIVLTLTLFEDREMIEERLKTYAHLFDDKVMKQLKRRRYTGWGRLSRKLINGIRDKQSGKTILDFLK
SDGFANRNFMQLIHDDSLTFKEDIQKAQVSGQGDSLHEHIANLAGSPAIKKGILQTVKVVDELVKVMGRHKPENIV
IEMARENQTTQKGQKNSRERMKRIEEGIKELGSQILKEHPVENTQLQNEKLYLYYLQNGRDMYVDQELDINRLSDY
DVDHIVPQSFLKDDSIDNKVLTRSDKNRGKSDNVPSEEVVKKMKNYWRQLLNAKLITQRKFDNLTKAERGGLSELD
KAGFIKRQLVETRQITKHVAQILDSRMNTKYDENDKLIREVKVITLKSKLVSDFRKDFQFYKVREINNYHHAHDAY
LNAVVGTALIKKYPKLESEFVYGDYKVYDVRKMIAKSEQEIGKATAKYFFYSNIMNFFKTEITLANGEIRKRPLIE
TNGETGEIVWDKGRDFATVRKVLSMPQVNIVKKTEVQTGGFSKESILPKRNSDKLIARKKDWDPKKYGGFDSPTVA
YSVLVVAKVEGKSKKLKSVKELLGITIMERSSFEKNPIDFLEAKGYKEVKKDLIIKLPKYSLFELENGRKRMLAS
AGELQKGNELALPSKYVNFLYLASHYEKLKGSPEDNEQKQLFVEQHKHYLDEIIEQISEFSKRVILADANLDKVLS
AYNKHRDKPIREQAENIIHLFTLTNLGAPAAFKYFDTTIDRKRYTSTKEVLDATLIHQSITGLYETRIDLSQLGGD
AEAAAKEAAAKEAAAKEAAAKALEAEAAAKEAAAKEAAAKEAAAKA*MVSKGEEDNMAIIKEFMRFKVHMEGSVNGH*
*EFEIEGEGEGRPYEGTQTAKLKVTKGGPLPFAWDILSPQFMYGSKAYVKHPADIPDYLKLSFPEGFKWERVMNFED*
*GGVVTVTQDSSLQDGEFIYKVKLRGTNFPSDGPVMQKKTMGWEASSERMYPEDGALKGEIKQRLKLKDGGHYDAEV*
*KTTYKAKKPVQLPGAYNVNIKLDITSHNEDYTIVEQYERAEGRHSTGGMDELYK*

SEQ ID NO: 76
MDKKYSIGLDIGTNSVGWAVITDEYKVPSKKFKVLGNTDRHSIKKNLIGALLFDSGETAEATRLKRTARRRYTRRK
NRICYLQEIFSNEMAKVDDSFFHRLEESFLVEEDKKHERHPIFGNIVDEVAYHEKYPTIYHLRKKLVDSTDKADLR

TABLE V.2-continued

Cas9-Linker-mCherryChimeras

```
LIYLALAHMIKFRGHFLIEGDLNPDNSDVDKLFIQLVQTYNQLFEENPINASGVDAKAILSARLSKSRRLENLIAQ
LPGEKKNGLFGNLIALSLGLTPNFKSNFDLAEDAKLQLSKDTYDDDLDNLLAQIGDQYADLFLAAKNLSDAILLSD
ILRVNTEITKAPLSASMIKRYDEHHQDLTLLKALVRQQLPEKYKEIFFDQSKNGYAGYIDGGASQEEFYKFIKPIL
EKMDGTEELLVKLNREDLLRKQRTFDNGSIPHQIHLGELHAILRRQEDFYPFLKDNREKIEKILTFRIPYYVGPLA
RGNSRFAWMTRKSEETITPWNFEEVVDKGASAQSFIERMTNFDKNLPNEKVLPKHSLLYEYFTVYNELTKVKYTE
GMRKPAFLSGEQKKAIVDLLFKTNRKVTVKQLKEDYFKKIECFDSVEISGVEDRFNASLGTYHDLLKIIKDKDFLD
NEENEDILEDIVLTLTLFEDREMIEERLKTYAHLFDDKVMKQLKRRRYTGWGRLSRKLINGIRDKQSGKTILDFLK
SDGFANRNFMQLIHDDSLTFKEDIQKAQVSGQGDSLHEHIANLAGSPAIKKGILQTVKVVDELVKVMGRHKPENIV
IEMARENQTTQKGQKNSRERMKRIEEGIKELGSQILKEHPVENTQLQNEKLYLYYLQNGRDMYVDQELDINRLSDY
DVDHIVPQSFLKDDSIDNKVLTRSDKNRGKSDNVPSEEVVKKMKNYWRQLLNAKLITQRKFDNLTKAERGGLSELD
KAGFIKRQLVETRQITKHVAQILDSRMNTKYDENDKLIREVKVITLKSKLVSDFRKDFQFYKVREINNYHHAHDAY
LNAVVGTALIKKYPKLESEFVYGDYKVYDVRKMIAKSEQEIGKATAKYFFYSNIMNFFKTEITLANGEIRKRPLIE
TNGETGEIVWDKGRDFATVRKVLSMPQVNIVKKTEVQTGGFSKESILPKRNSDKLIARKKDWDPKKYGGFDSPTVA
YSVLVVAKVEKGKSKKLKSVKELLGITIMERSSFEKNPIDFLEAKGYKEVKKDLIIKLPKYSLFELENGRKRMLAS
AGELQKGNELALPSKYVNFLYLASHYEKLKGSPEDNEQKQLFVEQHKHYLDEIIEQISEFSKRVILADANLDKVLS
AYNKHRDKPIREQAENIIHLFTLTNLGAPAAFKYFDTTIDRKRYTSTKEVLDATLIHQSITGLYETRIDLSQLGGD
LEAEAAAKEAAAKEAAAKALEAEAAAKEAAAKEAAAKEAAAKALE*MVSKGEEDNMAIIKEFMRFKVHMEGS*
*VNGHEFEIEGEGEGRPYEGTQTAKLKVTKGGPLPFAWDILSPQFMYGSKAYVKHPADIPDYLKLSFPEGFKWERVM*
*NFEDGGVVTVTQDSSLQDGEFIYKVKLRGTNFPSDGPVMQKKTMGWEASSERMYPEDGALKGEIKQRLKLKDGGHY*
*DAEVKTTYKAKKPVQLPGAYNVNIKLDITSHNEDYTIVEQYERAEGRHSTGGMDELYK*

SEQ ID NO: 77
MDKKYSIGLDIGTNSVGWAVITDEYKVPSKKFKVLGNTDRHSIKKNLIGALLFDSGETAEATRLKRTARRRYTRRK
NRICYLQEIFSNEMAKVDDSFFHRLEESFLVEEDKKHERHPIFGNIVDEVAYHEKYPTIYHLRKKLVDSTDKADLR
LIYLALAHMIKFRGHFLIEGDLNPDNSDVDKLFIQLVQTYNQLFEENPINASGVDAKAILSARLSKSRRLENLIAQ
LPGEKKNGLFGNLIALSLGLTPNFKSNFDLAEDAKLQLSKDTYDDDLDNLLAQIGDQYADLFLAAKNLSDAILLSD
ILRVNTEITKAPLSASMIKRYDEHHQDLTLLKALVRQQLPEKYKEIFFDQSKNGYAGYIDGGASQEEFYKFIKPIL
EKMDGTEELLVKLNREDLLRKQRTFDNGSIPHQIHLGELHAILRRQEDFYPFLKDNREKIEKILTFRIPYYVGPLA
RGNSRFAWMTRKSEETITPWNFEEVVDKGASAQSFIERMTNFDKNLPNEKVLPKHSLLYEYFTVYNELTKVKYTE
GMRKPAFLSGEQKKAIVDLLFKTNRKVTVKQLKEDYFKKIECFDSVEISGVEDRFNASLGTYHDLLKIIKDKDFLD
NEENEDILEDIVLTLTLFEDREMIEERLKTYAHLFDDKVMKQLKRRRYTGWGRLSRKLINGIRDKQSGKTILDFLK
SDGFANRNFMQLIHDDSLTFKEDIQKAQVSGQGDSLHEHIANLAGSPAIKKGILQTVKVVDELVKVMGRHKPENIV
IEMARENQTTQKGQKNSRERMKRIEEGIKELGSQILKEHPVENTQLQNEKLYLYYLQNGRDMYVDQELDINRLSDY
DVDHIVPQSFLKDDSIDNKVLTRSDKNRGKSDNVPSEEVVKKMKNYWRQLLNAKLITQRKFDNLTKAERGGLSELD
KAGFIKRQLVETRQITKHVAQILDSRMNTKYDENDKLIREVKVITLKSKLVSDFRKDFQFYKVREINNYHHAHDAY
LNAVVGTALIKKYPKLESEFVYGDYKVYDVRKMIAKSEQEIGKATAKYFFYSNIMNFFKTEITLANGEIRKRPLIE
TNGETGEIVWDKGRDFATVRKVLSMPQVNIVKKTEVQTGGFSKESILPKRNSDKLIARKKDWDPKKYGGFDSPTVA
YSVLVVAKVEKGKSKKLKSVKELLGITIMERSSFEKNPIDFLEAKGYKEVKKDLIIKLPKYSLFELENGRKRMLAS
AGELQKGNELALPSKYVNFLYLASHYEKLKGSPEDNEQKQLFVEQHKHYLDEIIEQISEFSKRVILADANLDKVLS
AYNKHRDKPIREQAENIIHLFTLTNLGAPAAFKYFDTTIDRKRYTSTKEVLDATLIHQSITGLYETRIDLSQLGGD
APA*MVSKGEEDNMAIIKEFMRFKVHMEGSVNGHEFEIEGEGEGRPYEGTQTAKLKVTKGGPLPFAWDILSPQFMYG*
*SKAYVKHPADIPDYLKLSFPEGFKWERVMNFEDGGVVTVTQDSSLQDGEFIYKVKLRGTNFPSDGPVMQKKTMGWE*
*ASSERMYPEDGALKGEIKQRLKLKDGGHYDAEVKTTYKAKKPVQLPGAYNVNIKLDITSHNEDYTIVEQYERAEGR*
*HSTGGMDELYK*

SEQ ID NO: 78
MDKKYSIGLDIGTNSVGWAVITDEYKVPSKKFKVLGNTDRHSIKKNLIGALLFDSGETAEATRLKRTARRRYTRRK
NRICYLQEIFSNEMAKVDDSFFHRLEESFLVEEDKKHERHPIFGNIVDEVAYHEKYPTIYHLRKKLVDSTDKADLR
LIYLALAHMIKFRGHFLIEGDLNPDNSDVDKLFIQLVQTYNQLFEENPINASGVDAKAILSARLSKSRRLENLIAQ
LPGEKKNGLFGNLIALSLGLTPNFKSNFDLAEDAKLQLSKDTYDDDLDNLLAQIGDQYADLFLAAKNLSDAILLSD
ILRVNTEITKAPLSASMIKRYDEHHQDLTLLKALVRQQLPEKYKEIFFDQSKNGYAGYIDGGASQEEFYKFIKPIL
EKMDGTEELLVKLNREDLLRKQRTFDNGSIPHQIHLGELHAILRRQEDFYPFLKDNREKIEKILTFRIPYYVGPLA
RGNSRFAWMTRKSEETITPWNFEEVVDKGASAQSFIERMTNFDKNLPNEKVLPKHSLLYEYFTVYNELTKVKYTE
GMRKPAFLSGEQKKAIVDLLFKTNRKVTVKQLKEDYFKKIECFDSVEISGVEDRFNASLGTYHDLLKIIKDKDFLD
NEENEDILEDIVLTLTLFEDREMIEERLKTYAHLFDDKVMKQLKRRRYTGWGRLSRKLINGIRDKQSGKTILDFLK
SDGFANRNFMQLIHDDSLTFKEDIQKAQVSGQGDSLHEHIANLAGSPAIKKGILQTVKVVDELVKVMGRHKPENIV
IEMARENQTTQKGQKNSRERMKRIEEGIKELGSQILKEHPVENTQLQNEKLYLYYLQNGRDMYVDQELDINRLSDY
DVDHIVPQSFLKDDSIDNKVLTRSDKNRGKSDNVPSEEVVKKMKNYWRQLLNAKLITQRKFDNLTKAERGGLSELD
KAGFIKRQLVETRQITKHVAQILDSRMNTKYDENDKLIREVKVITLKSKLVSDFRKDFQFYKVREINNYHHAHDAY
LNAVVGTALIKKYPKLESEFVYGDYKVYDVRKMIAKSEQEIGKATAKYFFYSNIMNFFKTEITLANGEIRKRPLIE
TNGETGEIVWDKGRDFATVRKVLSMPQVNIVKKTEVQTGGFSKESILPKRNSDKLIARKKDWDPKKYGGFDSPTVA
YSVLVVAKVEKGKSKKLKSVKELLGITIMERSSFEKNPIDFLEAKGYKEVKKDLIIKLPKYSLFELENGRKRMLAS
AGELQKGNELALPSKYVNFLYLASHYEKLKGSPEDNEQKQLFVEQHKHYLDEIIEQISEFSKRVILADANLDKVLS
AYNKHRDKPIREQAENIIHLFTLINLGAPAAFKYFDTTIDRKRYTSTKEVLDATLIHQSITGLYETRIDLSQLGGD
APAPA*MVSKGEEDNMAIIKEFMRFKVHMEGSVNGHEFEIEGEGEGRPYEGTQTAKLKVTKGGPLPFAWDILSPQFM*
*YGSKAYVKHPADIPDYLKLSFPEGFKWERVMNFEDGGVVTVTQDSSLQDGEFIYKVKLRGTNFPSDGPVMQKKTMG*
*WEASSERMYPEDGALKGEIKQRLKLKDGGHYDAEVKTTYKAKKPVQLPGAYNVNIKLDITSHNEDYTIVEQYERAE*
*GRHSTGGMDELYK*

SEQ ID NO: 79
MDKKYSIGLDIGTNSVGWAVITDEYKVPSKKFKVLGNTDRHSIKKNLIGALLFDSGETAEATRLKRTARRRYTRRK
NRICYLQEIFSNEMAKVDDSFFHRLEESFLVEEDKKHERHPIFGNIVDEVAYHEKYPTIYHLRKKLVDSTDKADLR
LIYLALAHMIKFRGHFLIEGDLNPDNSDVDKLFIQLVQTYNQLFEENPINASGVDAKAILSARLSKSRRLENLIAQ
LPGEKKNGLFGNLIALSLGLTPNFKSNFDLAEDAKLQLSKDTYDDDLDNLLAQIGDQYADLFLAAKNLSDAILLSD
ILRVNTEITKAPLSASMIKRYDEHHQDLTLLKALVRQQLPEKYKEIFFDQSKNGYAGYIDGGASQEEFYKFIKPIL
EKMDGTEELLVKLNREDLLRKQRTFDNGSIPHQIHLGELHAILRRQEDFYPFLKDNREKIEKILTFRIPYYVGPLA
RGNSRFAWMTRKSEETITPWNFEEVVDKGASAQSFIERMTNFDKNLPNEKVLPKHSLLYEYFTVYNELTKVKYTE
GMRKPAFLSGEQKKAIVDLLFKTNRKVTVKQLKEDYFKKIECFDSVEISGVEDRFNASLGTYHDLLKIIKDKDFLD
```

TABLE V.2-continued

Cas9-Linker-mCherryChimeras

NEENEDILEDIVLTLTLFEDREMIEERLKTYAHLFDDKVMKQLKRRRYTGWGRLSRKLINGIRDKQSGKTILDFLK
SDGFANRNFMQLIHDDSLTFKEDIQKAQVSGQGDSLHEHIANLAGSPAIKKGILQTVKVVDELVKVMGRHKPENIV
IEMARENQTTQKGQKNSRERMKRIEEGIKELGSQILKEHPVENTQLQNEKLYLYYLQNGRDMYVDQELDINRLSDY
DVDHIVPQSFLKDDSIDNKVLTRSDKNRGKSDNVPSEEVVKKMKNYWRQLLNAKLITQRKFDNLTKAERGGLSELD
KAGFIKRQLVETRQITKHVAQILDSRMNTKYDENDKLIREVKVITLKSKLVSDFRKDFQFYKVREINNYHHAHDAY
LNAVVGTALIKKYPKLESEFVYGDYKVYDVRKMIAKSEQEIGKATAKYFFYSNIMNFFKTEITLANGEIRKRPLIE
TNGETGEIVWDKGRDFATVRKVLSMPQVNIVKKTEVQTGGFSKESILPKRNSDKLIARKKDWDPKKYGGFDSPTVA
YSVLVVAKVEKGKSKKLKSVKELLGITIMERSSFEKNPIDFLEAKGYKEVKKDLIIKLPKYSLFELENGRKRMLAS
AGELQKGNELALPSKYVNFLYLASHYEKLKGSPEDNEQKQLFVEQHKHYLDEIIEQISEFSKRVILADANLDKVLS
AYNKHRDKPIREQAENIIHLFTLTNLGAPAAFKYFDTTIDRKRYTSTKEVLDATLIHQSITGLYETRIDLSQLGGD
APAPAPA*MVSKGEEDNMAIIKEFMRFKVHMEGSVNGHEFEIEGEGEGRPYEGTQTAKLVKTKGGPLPFAWDILSPQ*
*FMYGSKAYVKHPADIPDYLKLSFPEGFKWERVMNFEDGGVVTVTQDSSLQDGEFIYKVKLRGTNFPSDGPVMQKKT*
*MGWEASSERMYPEDGALKGEIKQRLKLKDGGHYDAEVKTTYKAKKPVQLPGAYNVNIKLDITSHNEDYTIVEQYER*
*AEGRHSTGGMDELYK*

SEQ ID NO: 80
MDKKYSIGLDIGTNSVGWAVITDEYKVPSKKFKVLGNTDRHSIKKNLIGALLFDSGETAEATRLKRTARRRYTRRK
NRICYLQEIFSNEMAKVDDSFFHRLEESFLVEEDKKHERHPIFGNIVDEVAYHEKYPTIYHLRKKLVDSTDKADLR
LIYLALAHMIKFRGHFLIEGDLNPDNSDVDKLFIQLVQTYNQLFEENPINASGVDAKAILSARLSKSRRLENLIAQ
LPGEKKNGLFGNLIALSLGLTPNFKSNFDLAEDAKLQLSKDTYDDDLDNLLAQIGDQYADLFLAAKNLSDAILLSD
ILRVNTEITKAPLSASMIKRYDEHHQDLTLLKALVRQQLPEKYKEIFFDQSKNGYAGYIDGGASQEEFYKFIKPIL
EKMDGTEELLVKLNREDLLRKQRTFDNGSIPHQIHLGELHAILRRQEDFYPFLKDNREKIEKILTFRIPYYVGPLA
RGNSRFAWMTRKSEETITPWNFEEVVDKGASAQSFIERMTNFDKNLPNEKVLPKHSLLYEYFTVYNELTKVKYTE
GMRKPAFLSGEQKKAIVDLLFKTNRKVTVKQLKEDYFKKIECFDSVEISGVEDRFNASLGTYHDLLKIIKDKDFLD
NEENEDILEDIVLTLTLFEDREMIEERLKTYAHLFDDKVMKQLKRRRYTGWGRLSRKLINGIRDKQSGKTILDFLK
SDGFANRNFMQLIHDDSLTFKEDIQKAQVSGQGDSLHEHIANLAGSPAIKKGILQTVKVVDELVKVMGRHKPENIV
IEMARENQTTQKGQKNSRERMKRIEEGIKELGSQILKEHPVENTQLQNEKLYLYYLQNGRDMYVDQELDINRLSDY
DVDHIVPQSFLKDDSIDNKVLTRSDKNRGKSDNVPSEEVVKKMKNYWRQLLNAKLITQRKFDNLTKAERGGLSELD
KAGFIKRQLVETRQITKHVAQILDSRMNTKYDENDKLIREVKVITLKSKLVSDFRKDFQFYKVREINNYHHAHDAY
LNAVVGTALIKKYPKLESEFVYGDYKVYDVRKMIAKSEQEIGKATAKYFFYSNIMNFFKTEITLANGEIRKRPLIE
TNGETGEIVWDKGRDFATVRKVLSMPQVNIVKKTEVQTGGFSKESILPKRNSDKLIARKKDWDPKKYGGFDSPTVA
YSVLVVAKVEKGKSKKLKSVKELLGITIMERSSFEKNPIDFLEAKGYKEVKKDLIIKLPKYSLFELENGRKRMLAS
AGELQKGNELALPSKYVNFLYLASHYEKLKGSPEDNEQKQLFVEQHKHYLDEIIEQISEFSKRVILADANLDKVLS
AYNKHRDKPIREQAENIIHLFTLTNLGAPAAFKYFDTTIDRKRYTSTKEVLDATLIHQSITGLYETRIDLSQLGGD
APAPAPA*MVSKGEEDNMAIIKEFMRFKVHMEGSVNGHEFEIEGEGEGRPYEGTQTAKLVKTKGGPLPFAWDILS*
*PQFMYGSKAYVKHPADIPDYLKLSFPEGFKWERVMNFEDGGVVTVTQDSSLQDGEFIYKVKLRGTNFPSDGPVMQK*
*KTMGWEASSERMYPEDGALKGEIKQRLKLKDGGHYDAEVKTTYKAKKPVQLPGAYNVNIKLDITSHNEDYTIVEQY*
*ERAEGRHSTGGMDELYK*

SEQ ID NO: 81
MDKKYSIGLDIGTNSVGWAVITDEYKVPSKKFKVLGNTDRHSIKKNLIGALLFDSGETAEATRLKRTARRRYTRRK
NRICYLQEIFSNEMAKVDDSFFHRLEESFLVEEDKKHERHPIFGNIVDEVAYHEKYPTIYHLRKKLVDSTDKADLR
LIYLALAHMIKFRGHFLIEGDLNPDNSDVDKLFIQLVQTYNQLFEENPINASGVDAKAILSARLSKSRRLENLIAQ
LPGEKKNGLFGNLIALSLGLTPNFKSNFDLAEDAKLQLSKDTYDDDLDNLLAQIGDQYADLFLAAKNLSDAILLSD
ILRVNTEITKAPLSASMIKRYDEHHQDLTLLKALVRQQLPEKYKEIFFDQSKNGYAGYIDGGASQEEFYKFIKPIL
EKMDGTEELLVKLNREDLLRKQRTFDNGSIPHQIHLGELHAILRRQEDFYPFLKDNREKIEKILTFRIPYYVGPLA
RGNSRFAWMTRKSEETITPWNFEEVVDKGASAQSFIERMTNFDKNLPNEKVLPKHSLLYEYFTVYNELTKVKYTE
GMRKPAFLSGEQKKAIVDLLFKTNRKVTVKQLKEDYFKKIECFDSVEISGVEDRFNASLGTYHDLLKIIKDKDFLD
NEENEDILEDIVLTLTLFEDREMIEERLKTYAHLFDDKVMKQLKRRRYTGWGRLSRKLINGIRDKQSGKTILDFLK
SDGFANRNFMQLIHDDSLTFKEDIQKAQVSGQGDSLHEHIANLAGSPAIKKGILQTVKVVDELVKVMGRHKPENIV
IEMARENQTTQKGQKNSRERMKRIEEGIKELGSQILKEHPVENTQLQNEKLYLYYLQNGRDMYVDQELDINRLSDY
DVDHIVPQSFLKDDSIDNKVLTRSDKNRGKSDNVPSEEVVKKMKNYWRQLLNAKLITQRKFDNLTKAERGGLSELD
KAGFIKRQLVETRQITKHVAQILDSRMNTKYDENDKLIREVKVITLKSKLVSDFRKDFQFYKVREINNYHHAHDAY
LNAVVGTALIKKYPKLESEFVYGDYKVYDVRKMIAKSEQEIGKATAKYFFYSNIMNFFKTEITLANGEIRKRPLIE
TNGETGEIVWDKGRDFATVRKVLSMPQVNIVKKTEVQTGGFSKESILPKRNSDKLIARKKDWDPKKYGGFDSPTVA
YSVLVVAKVEKGKSKKLKSVKELLGITIMERSSFEKNPIDFLEAKGYKEVKKDLIIKLPKYSLFELENGRKRMLAS
AGELQKGNELALPSKYVNFLYLASHYEKLKGSPEDNEQKQLFVEQHKHYLDEIIEQISEFSKRVILADANLDKVLS
AYNKHRDKPIREQAENIIHLFTLTNLGAPAAFKYFDTTIDRKRYTSTKEVLDATLIHQSITGLYETRIDLSQLGGD
APAPAPAPA*MVSKGEEDNMAIIKEFMRFKVHMEGSVNGHEFEIEGEGEGRPYEGTQTAKLVKTKGGPLPFAWDI*
*LSPQFMYGSKAYVKHPADIPDYLKLSFPEGFKWERVMNFEDGGVVTVTQDSSIQDGEFIYKVKLRGTNFPSDGPVM*
*QKKTMGWEASSERMYPEDGALKGEIKQRLKLKDGGHYDAEVKTTYKAKKPVQLPGAYNVNIKLDITSHNEDYTIVE*
*QYERAEGRHSTGGMDELYK*

SEQ ID NO: 82
MDKKYSIGLDIGTNSVGWAVITDEYKVPSKKFKVLGNTDRHSIKKNLIGALLFDSGETAEATRLKRTARRRYTRRK
NRICYLQEIFSNEMAKVDDSFFHRLEESFLVEEDKKHERHPIFGNIVDEVAYHEKYPTIYHLRKKLVDSTDKADLR
LIYLALAHMIKFRGHFLIEGDLNPDNSDVDKLFIQLVQTYNQLFEENPINASGVDAKAILSARLSKSRRLENLIAQ
LPGEKKNGLFGNLIALSLGLTPNFKSNFDLAEDAKLQLSKDTYDDDLDNLLAQIGDQYADLFLAAKNLSDAILLSD
ILRVNTEITKAPLSASMIKRYDEHHQDLTLLKALVRQQLPEKYKEIFFDQSKNGYAGYIDGGASQEEFYKFIKPIL
EKMDGTEELLVKLNREDLLRKQRTFDNGSIPHQIHLGELHAILRRQEDFYPFLKDNREKIEKILTFRIPYYVGPLA
RGNSRFAWMTRKSEETITPWNFEEVVDKGASAQSFIERMTNFDKNLPNEKVLPKHSLLYEYFTVYNELTKVKYTE
GMRKPAFLSGEQKKAIVDLLFKTNRKVTVKQLKEDYFKKIECFDSVEISGVEDRFNASLGTYHDLLKIIKDKDFLD
NEENEDILEDIVLTLTLFEDREMIEERLKTYAHLFDDKVMKQLKRRRYTGWGRLSRKLINGIRDKQSGKTILDFLK
SDGFANRNFMQLIHDDSLTFKEDIQKAQVSGQGDSLHEHIANLAGSPAIKKGILQTVKVVDELVKVMGRHKPENIV
IEMARENQTTQKGQKNSRERMKRIEEGIKELGSQILKEHPVENTQLQNEKLYLYYLQNGRDMYVDQELDINRLSDY
DVDHIVPQSFLKDDSIDNKVLTRSDKNRGKSDNVPSEEVVKKMKNYWRQLLNAKLITQRKFDNLTKAERGGLSELD
KAGFIKRQLVETRQITKHVAQILDSRMNTKYDENDKLIREVKVITLKSKLVSDFRKDFQFYKVREINNYHHAHDAY
LNAVVGTALIKKYPKLESEFVYGDYKVYDVRKMIAKSEQEIGKATAKYFFYSNIMNFFKTEITLANGEIRKRPLIE

TABLE V.2-continued

Cas9-Linker-mCherryChimeras

TNGETGEIVWDKGRDFATVRKVLSMPQVNIVKKTEVQTGGFSKESILPKRNSDKLIARKKDWDPKKYGGFDSPTVA
YSVLVVAKVEKGKSKKLKSVKELLGITIMERSSFEKNPIDFLEAKGYKEVKKDLIIKLPKYSLFELENGRKRMLAS
AGELQKGNELALPSKYVNFLYLASHYEKLKGSPEDNEQKQLFVEQHKHYLDEIIEQISEFSKRVILADANLDKVLS
AYNKHRDKPIREQAENIIHLFTLTNLGAPAAFKYFDTTIDRKRYTSTKEVLDATLIHQSITGLYETRIDLSQLGGD
APAPAPAPAPAPA*MVSKGEEDNMAIIKEFMRFKVHMEGSVNGHEFEIEGEGEGRPYEGTQTAKLVTKGGPLPFAW
DILSPQFMYGSKAYVKHPADIPDYLKLSFPEGFKWERVMNFEDGGVVTVTQDSSLQDGEFIYKVKLRGTNFPSDGP
VMQKKTMGWEASSERMYPEDGALKGEIKQRLKLKDGGHYDAEVKTTYKAKKPVQLPGAYNVNIKLDITSHNEDYTI
VEQYERAEGRHSTGGMDELYK*

SEQ ID NO: 83
MDKKYSIGLDIGTNSVGWAVITDEYKVPSKKFKVLGNTDRHSIKKNLIGALLFDSGETAEATRLKRTARRRYTRRK
NRICYLQEIFSNEMAKVDDSFFHRLEESFLVEEDKKHERHPIFGNIVDEVAYHEKYPTIYHLRKKLVDSTDKADLR
LIYLALAHMIKFRGHFLIEGDLNPDNSDVDKLFIQLVQTYNQLFEENPINASGVDAKAILSARLSKSRRLENLIAQ
LPGEKKNGLFGNLIALSLGLTPNFKSNFDLAEDAKLQLSKDTYDDDLDNLLAQIGDQYADLFLAAKNLSDAILLSD
ILRVNTEITKAPLSASMIKRYDEHHQDLTLLKALVRQQLPEKYKEIFFDSKNGYAGYIDGGASQEEFYKFIKPIL
EKMDGTEELLVKLNREDLLRKQRTFDNGSIPHQIHLGELHAILRRQEDFYPFLKDNREKIEKILTFRIPYYVGPLA
RGNSRFAWMTRKSEETITPWNFEEVVDKGASAQSFIERMTNFDKNLPNEKVLPKHSLLYEYFTVYNELTKVKYTE
GMRKPAFLSGEQKKAIVDLLFKTNRKVTVKQLKEDYFKKIECFDSVEISGVEDRFNASLGTYHDLLKIIKDKDFLD
NEENEDILEDIVLTLTLFEDREMIEERLKTYAHLFDDKVMKQLKRRRYTGWGRLSRKLINGIRDKQSGKTILDFLK
SDGFANRNFMQLIHDDSLTFKEDIQKAQVSGQGDSLHEHIANLAGSPAIKKGILQTVKVVDELVKVMGRHKPENIV
IEMARENQTTQKGQKNSRERMKRIEEGIKELGSQILKEHPVENTQLQNEKLYLYYLQNGRDMYVDQELDINRLSDY
DVDHIVPQSFLKDDSIDNKVLTRSDKNRGKSDNVPSEEVVKKMKNYWRQLLNAKLITQRKFDNLTKAERGGLSELD
KAGFIKRQLVETRQITKHVAQILDSRMNTKYDENDKLIREVKVITLKSKLVSDFRKDFQFYKVREINNYHHAHDAY
LNAVVGTALIKKYPKLESEFVYGDYKVYDVRKMIAKSEQEIGKATAKYFFYSNIMNFFKTEITLANGEIRKRPLIE
TNGETGEIVWDKGRDFATVRKVLSMPQVNIVKKTEVQTGGFSKESILPKRNSDKLIARKKDWDPKKYGGFDSPTVA
YSVLVVAKVEKGKSKKLKSVKELLGITIMERSSFEKNPIDFLEAKGYKEVKKDLIIKLPKYSLFELENGRKRMLAS
AGELQKGNELALPSKYVNFLYLASHYEKLKGSPEDNEQKQLFVEQHKHYLDEIIEQISEFSKRVILADANLDKVLS
AYNKHRDKPIREQAENIIHLFTLTNLGAPAAFKYFDTTIDRKRYTSTKEVLDATLIHQSITGLYETRIDLSQLGGD
APAPAPAPAPAPA*MVSKGEEDNMAIIKEFMRFKVHMEGSVNGHEFEIEGEGEGRPYEGTQTAKLVTKGGPLPF
AWDILSPQFMYGSKAYVKHPADIPDYLKLSFPEGFKWERVMNFEDGGVVTVTQDSSLQDGEFIYKVKLRGTNFPSD
GPVMQKKTMGWEASSERMYPEDGALKGEIKQRLKLKDGGHYDAEVKTTYKAKKPVQLPGAYNVNIKLDITSHNEDY
TIVEQYERAEGRHSTGGMDELYK*

SEQ ID NO: 84
MDKKYSIGLDIGTNSVGWAVITDEYKVPSKKFKVLGNTDRHSIKKNLIGALLFDSGETAEATRLKRTARRRYTRRK
NRICYLQEIFSNEMAKVDDSFFHRLEESFLVEEDKKHERHPIFGNIVDEVAYHEKYPTIYHLRKKLVDSTDKADLR
LIYLALAHMIKFRGHFLIEGDLNPDNSDVDKLFIQLVQTYNQLFEENPINASGVDAKAILSARLSKSRRLENLIAQ
LPGEKKNGLFGNLIALSLGLTPNFKSNFDLAEDAKLQLSKDTYDDDLDNLLAQIGDQYADLFLAAKNLSDAILLSD
ILRVNTEITKAPLSASMIKRYDEHHQDLTLLKALVRQQLPEKYKEIFFDQSKNGYAGYIDGGASQEEFYKFIKPIL
EKMDGTEELLVKLNREDLLRKQRTFDNGSIPHQIHLGELHAILRRQEDFYPFLKDNREKIEKILTFRIPYYVGPLA
RGNSRFAWMTRKSEETITPWNFEEVVDKGASAQSFIERMTNFDKNLPNEKVLPKHSLLYEYFTVYNELTKVKYTE
GMRKPAFLSGEQKKAIVDLLFKTNRKVTVKQLKEDYFKKIECFDSVEISGVEDRFNASLGTYHDLLKIIKDKDFLD
NEENEDILEDIVLTLTLFEDREMIEERLKTYAHLFDDKVMKQLKRRRYTGWGRLSRKLINGIRDKQSGKTILDFLK
SDGFANRNFMQLIHDDSLTFKEDIQKAQVSGQGDSLHEHIANLAGSPAIKKGILQTVKVVDELVKVMGRHKPENIV
IEMARENQTTQKGQKNSRERMKRIEEGIKELGSQILKEHPVENTQLQNEKLYLYYLQNGRDMYVDQELDINRLSDY
DVDHIVPQSFLKDDSIDNKVLTRSDKNRGKSDNVPSEEVVKKMKNYWRQLLNAKLITQRKFDNLTKAERGGLSELD
KAGFIKRQLVETRQITKHVAQILDSRMNTKYDENDKLIREVKVITLKSKLVSDFRKDFQFYKVREINNYHHAHDAY
LNAVVGTALIKKYPKLESEFVYGDYKVYDVRKMIAKSEQEIGKATAKYFFYSNIMNFFKTEITLANGEIRKRPLIE
TNGETGEIVWDKGRDFATVRKVLSMPQVNIVKKTEVQTGGFSKESILPKRNSDKLIARKKDWDPKKYGGFDSPTVA
YSVLVVAKVEKGKSKKLKSVKELLGITIMERSSFEKNPIDFLEAKGYKEVKKDLIIKLPKYSLFELENGRKRMLAS
AGELQKGNELALPSKYVNFLYLASHYEKLKGSPEDNEQKQLFVEQHKHYLDEIIEQISEFSKRVILADANLDKVLS
AYNKHRDKPIREQAENIIHLFTLTNLGAPAAFKYFDTTIDRKRYTSTKEVLDATLIHQSITGLYETRIDLSQLGGD
APAPAPAPAPAPAPA*MVSKGEEDNMAIIKEFMRFKVHMEGSVNGHEFEIEGEGEGRPYEGTQTAKLVTKGGPL
PFAWDILSPQFMYGSKAYVKHPADIPDYLKLSFPEGFKWERVMNFEDGGVVTVTQDSSLQDGEFIYKVKLRGTNFP
SDGPVMQKKTMGWEASSERMYPEDGALKGEIKQRLKLKDGGHYDAEVKTTYKAKKPVQLPGAYNVNIKLDITSHNE
DYTIVEQYERAEGRHSTGGMDELYK*

SEQ ID NO: 85
MDKKYSIGLDIGTNSVGWAVITDEYKVPSKKFKVLGNTDRHSIKKNLIGALLFDSGETAEATRLKRTARRRYTRRK
NRICYLQEIFSNEMAKVDDSFFHRLEESFLVEEDKKHERHPIFGNIVDEVAYHEKYPTIYHLRKKLVDSTDKADLR
LIYLALAHMIKFRGHFLIEGDLNPDNSDVDKLFIQLVQTYNQLFEENPINASGVDAKAILSARLSKSRRLENLIAQ
LPGEKKNGLFGNLIALSLGLTPNFKSNFDLAEDAKLQLSKDTYDDDLDNLLAQIGDQYADLFLAAKNLSDAILLSD
ILRVNTEITKAPLSASMIKRYDEHHQDLTLLKALVRQQLPEKYKEIFFDQSKNGYAGYIDGGASQEEFYKFIKPIL
EKMDGTEELLVKLNREDLLRKQRTFDNGSIPHQIHLGELHAILRRQEDFYPFLKDNREKIEKILTFRIPYYVGPLA
RGNSRFAWMTRKSEETITPWNFEEVVDKGASAQSFIERMTNFDKNLPNEKVLPKHSLLYEYFTVYNELTKVKYTE
GMRKPAFLSGEQKKAIVDLLFKTNRKVTVKQLKEDYFKKIECFDSVEISGVEDRFNASLGTYHDLLKIIKDKDFLD
NEENEDILEDIVLTLTLFEDREMIEERLKTYAHLFDDKVMKQLKRRRYTGWGRLSRKLINGIRDKQSGKTILDFLK
SDGFANRNFMQLIHDDSLTFKEDIQKAQVSGQGDSLHEHIANLAGSPAIKKGILQTVKVVDELVKVMGRHKPENIV
IEMARENQTTQKGQKNSRERMKRIEEGIKELGSQILKEHPVENTQLQNEKLYLYYLQNGRDMYVDQELDINRLSDY
DVDHIVPQSFLKDDSIDNKVLTRSDKNRGKSDNVPSEEVVKKMKNYWRQLLNAKLITQRKFDNLTKAERGGLSELD
KAGFIKRQLVETRQITKHVAQILDSRMNTKYDENDKLIREVKVITLKSKLVSDFRKDFQFYKVREINNYHHAHDAY
LNAVVGTALIKKYPKLESEFVYGDYKVYDVRKMIAKSEQEIGKATAKYFFYSNIMNFFKTEITLANGEIRKRPLIE
TNGETGEIVWDKGRDFATVRKVLSMPQVNIVKKTEVQTGGFSKESILPKRNSDKLIARKKDWDPKKYGGFDSPTVA
YSVLVVAKVEKGKSKKLKSVKELLGITIMERSSFEKNPIDFLEAKGYKEVKKDLIIKLPKYSLFELENGRKRMLAS
AGELQKGNELALPSKYVNFLYLASHYEKLKGSPEDNEQKQLFVEQHKHYLDEIIEQISEFSKRVILADANLDKVLS
AYNKHRDKPIREQAENIIHLFTLTNLGAPAAFKYFDTTIDRKRYTSTKEVLDATLIHQSITGLYETRIDLSQLGGD
APAPAPAPAPAPAPA*MVSKGEEDNMAIIKEFMRFKVHMEGSVNGHEFEIEGEGEGRPYEGTQTAKLVTKGG
PLPFAWDILSPQFMYGSKAYVKHPADIPDYLKLSFPEGFKWERVMNFEDGGVVTVTQDSSLQDGEFIYKVKLRGTN*

TABLE V.2-continued

Cas9-Linker-mCherryChimeras

*FPSDGPVMQKKTMGWEASSERMYPEDGALKGEIKQRLKLKDGGHYDAEVKTTYKAKKPVQLPGAYNVNIKLDITSH
NEDYTIVEQYERAEGRHSTGGMDELYK*

SEQ ID NO: 86
MDKKYSIGLDIGTNSVGWAVITDEYKVPSKKFKVLGNTDRHSIKKNLIGALLFDSGETAEATRLKRTARRRYTRRK
NRICYLQEIFSNEMAKVDDSFFHRLEESFLVEEDKKHERHPIFGNIVDEVAYHEKYPTIYHLRKKLVDSTDKADLR
LIYLALAHMIKFRGHFLIEGDLNPDNSDVDKLFIQLVQTYNQLFEENPINASGVDAKAILSARLSKSRRLENLIAQ
LPGEKKNGLFGNLIALSLGLTPNFKSNFDLAEDAKLQLSKDTYDDDLDNLLAQIGDQYADLFLAAKNLSDAILLSD
ILRVNTEITKAPLSASMIKRYDEHHQDLTLLKALVRQQLPEKYKEIFFDQSKNGYAGYIDGGASQEEFYKFIKPIL
EKMDGTEELLVKLNREDLLRKQRTFDNGSIPHQIHLGELHAILRRQEDFYPFLKDNREKIEKILTFRIPYYVGPLA
RGNSRFAWMTRKSEETITPWNFEEVVDKGASAQSFIERMTNFDKNLPNEKVLPKHSLLYEYFTVYNELTKVKYVTE
GMRKPAFLSGEQKKAIVDLLFKTNRKVTVKQLKEDYFKKIECFDSVEISGVEDRFNASLGTYHDLLKIIKDKDFLD
NEENEDILEDIVLTLTLFEDREMIEERLKTYAHLFDDKVMKQLRRRYTGWGRLSRKLINGIRDKQSGKTILDFLK
SDGFANRNFMQLIHDDSLTFKEDIQKAQVSGQGDSLHEHIANLAGSPAIKKGILQTVKVVDELVKVMGRHKPENIV
IEMARENQTTQKGQKNSRERMKRIEEGIKELGSQILKEHPVENTQLQNEKLYLYYLQNGRDMYVDQELDINRLSDY
DVDHIVPQSFLKDDSIDNKVLTRSDKNRGKSDNVPSEEVVKKMKNYWRQLLNAKLITQRKFDNLTKAERGGLSELD
KAGFIKRQLVETRQITKHVAQILDSRMNTKYDENDKLIREVKVITLKSKLVSDFRKDFQFYKVREINNYHHAHDAY
LNAVVGTALIKKYPKLESEFVYGDYKVYDVRKMIAKSEQEIGKATAKYFFYSNIMNFFKTEITLANGEIRKRPLIE
TNGETGEIVWDKGRDFATVRKVLSMPQVNIVKKTEVQTGGFSKESILPKRNSDKLIARKKDWDPKKYGGFDSPTVA
YSVLVVAKVEGKSKKLKSVKELLGITIMERSSFEKNPIDFLEAKGYKEVKKDLIIKLPKYSLFELENGRKRMLAS
AGELQKGNELALPSKYVNFLYLASHYEKLKGSPEDNEQKQLFVEQHKHYLDEIIEQISEFSKRVILADANLDKVLS
AYNKHRDKPIREQAENIIHLFTLINLGAPAAFKYFDTTIDRKRYTSTKEVLDATLIHQSITGLYETRIDLSQLGGD
APAPAPAPAPAPAPAPAPAPA***MVSKGEEDNMAIIKEFMRFKVHMEGSVNGHEFEIEGEGEGRPYEGTQTAKLKVTK
GGPLPFAWDILSPQFMYGSKAYVKHPADIPDYLKLSFPEGFKWERVMNFEDGGVVTVTQDSSLQDGEFIYKVKLRG
TNFPSDGPVMQKKTMGWEASSERMYPEDGALKGEIKQRLKLKDGGHYDAEVKTTYKAKKPVQLPGAYNVNIKLDIT
SHNEDYTIVEQYERAEGRHSTGGMDELYK***

SEQ ID NO: 87
MDKKYSIGLDIGTNSVGWAVITDEYKVPSKKFKVLGNTDRHSIKKNLIGALLFDSGETAEATRLKRTARRRYTRRK
NRICYLQEIFSNEMAKVDDSFFHRLEESFLVEEDKKHERHPIFGNIVDEVAYHEKYPTIYHLRKKLVDSTDKADLR
LIYLALAHMIKFRGHFLIEGDLNPDNSDVDKLFIQLVQTYNQLFEENPINASGVDAKAILSARLSKSRRLENLIAQ
LPGEKKNGLFGNLIALSLGLTPNFKSNFDLAEDAKLQLSKDTYDDDLDNLLAQIGDQYADLFLAAKNLSDAILLSD
ILRVNTEITKAPLSASMIKRYDEHHQDLTLLKALVRQQLPEKYKEIFFDQSKNGYAGYIDGGASQEEFYKFIKPIL
EKMDGTEELLVKLNREDLLRKQRTFDNGSIPHQIHLGELHAILRRQEDFYPFLKDNREKIEKILTFRIPYYVGPLA
RGNSRFAWMTRKSEETITPWNFEEVVDKGASAQSFIERMTNFDKNLPNEKVLPKHSLLYEYFTVYNELTKVKYVTE
GMRKPAFLSGEQKKAIVDLLFKTNRKVTVKQLKEDYFKKIECFDSVEISGVEDRFNASLGTYHDLLKIIKDKDFLD
NEENEDILEDIVLTLTLFEDREMIEERLKTYAHLFDDKVMKQLRRRYTGWGRLSRKLINGIRDKQSGKTILDFLK
SDGFANRNFMQLIHDDSLTFKEDIQKAQVSGQGDSLHEHIANLAGSPAIKKGILQTVKVVDELVKVMGRHKPENIV
IEMARENQTTQKGQKNSRERMKRIEEGIKELGSQILKEHPVENTQLQNEKLYLYYLQNGRDMYVDQELDINRLSDY
DVDHIVPQSFLKDDSIDNKVLTRSDKNRGKSDNVPSEEVVKKMKNYWRQLLNAKLITQRKFDNLTKAERGGLSELD
KAGFIKRQLVETRQITKHVAQILDSRMNTKYDENDKLIREVKVITLKSKLVSDFRKDFQFYKVREINNYHHAHDAY
LNAVVGTALIKKYPKLESEFVYGDYKVYDVRKMIAKSEQEIGKATAKYFFYSNIMNFFKTEITLANGEIRKRPLIE
TNGETGEIVWDKGRDFATVRKVLSMPQVNIVKKTEVQTGGFSKESILPKRNSDKLIARKKDWDPKKYGGFDSPTVA
YSVLVVAKVEGKSKKLKSVKELLGITIMERSSFEKNPIDFLEAKGYKEVKKDLIIKLPKYSLFELENGRKRMLAS
AGELQKGNELALPSKYVNFLYLASHYEKLKGSPEDNEQKQLFVEQHKHYLDEIIEQISEFSKRVILADANLDKVLS
AYNKHRDKPIREQAENIIHLFTLINLGAPAAFKYFDTTIDRKRYTSTKEVLDATLIHQSITGLYETRIDLSQLGGD
APAPAPAPAPAPAPAPAPAPAPA***MVSKGEEDNMAIIKEFMRFKVHMEGSVNGHEFEIEGEGEGRPYEGTQTAKLKV
TKGGPLPFAWDILSPQFMYGSKAYVKHPADIPDYLKLSFPEGFKWERVMNFEDGGVVTVTQDSSLQDGEFIYKVKL
RGTNFPSDGPVMQKKTMGWEASSERMYPEDGALKGEIKQRLKLKDGGHYDAEVKTTYKAKKPVQLPGAYNVNIKLD
ITSHNEDYTIVEQYERAEGRHSTGGMDELYK***

SEQ ID NO: 88
MDKKYSIGLDIGTNSVGWAVITDEYKVPSKKFKVLGNTDRHSIKKNLIGALLFDSGETAEATRLKRTARRRYTRRK
NRICYLQEIFSNEMAKVDDSFFHRLEESFLVEEDKKHERHPIFGNIVDEVAYHEKYPTIYHLRKKLVDSTDKADLR
LIYLALAHMIKFRGHFLIEGDLNPDNSDVDKLFIQLVQTYNQLFEENPINASGVDAKAILSARLSKSRRLENLIAQ
LPGEKKNGLFGNLIALSLGLTPNFKSNFDLAEDAKLQLSKDTYDDDLDNLLAQIGDQYADLFLAAKNLSDAILLSD
ILRVNTEITKAPLSASMIKRYDEHHQDLTLLKALVRQQLPEKYKEIFFDQSKNGYAGYIDGGASQEEFYKFIKPIL
EKMDGTEELLVKLNREDLLRKQRTFDNGSIPHQIHLGELHAILRRQEDFYPFLKDNREKIEKILTFRIPYYVGPLA
RGNSRFAWMTRKSEETITPWNFEEVVDKGASAQSFIERMTNFDKNLPNEKVLPKHSLLYEYFTVYNELTKVKYVTE
GMRKPAFLSGEQKKAIVDLLFKTNRKVTVKQLKEDYFKKIECFDSVEISGVEDRFNASLGTYHDLLKIIKDKDFLD
NEENEDILEDIVLTLTLFEDREMIEERLKTYAHLFDDKVMKQLRRRYTGWGRLSRKLINGIRDKQSGKTILDFLK
SDGFANRNFMQLIHDDSLTFKEDIQKAQVSGQGDSLHEHIANLAGSPAIKKGILQTVKVVDELVKVMGRHKPENIV
IEMARENQTTQKGQKNSRERMKRIEEGIKELGSQILKEHPVENTQLQNEKLYLYYLQNGRDMYVDQELDINRLSDY
DVDHIVPQSFLKDDSIDNKVLTRSDKNRGKSDNVPSEEVVKKMKNYWRQLLNAKLITQRKFDNLTKAERGGLSELD
KAGFIKRQLVETRQITKHVAQILDSRMNTKYDENDKLIREVKVITLKSKLVSDFRKDFQFYKVREINNYHHAHDAY
LNAVVGTALIKKYPKLESEFVYGDYKVYDVRKMIAKSEQEIGKATAKYFFYSNIMNFFKTEITLANGEIRKRPLIE
TNGETGEIVWDKGRDFATVRKVLSMPQVNIVKKTEVQTGGFSKESILPKRNSDKLIARKKDWDPKKYGGFDSPTVA
YSVLVVAKVEGKSKKLKSVKELLGITIMERSSFEKNPIDFLEAKGYKEVKKDLIIKLPKYSLFELENGRKRMLAS
AGELQKGNELALPSKYVNFLYLASHYEKLKGSPEDNEQKQLFVEQHKHYLDEIIEQISEFSKRVILADANLDKVLS
AYNKHRDKPIREQAENIIHLFTLINLGAPAAFKYFDTTIDRKRYTSTKEVLDATLIHQSITGLYETRIDLSQLGGD
APAPAPAPAPAPAPAPAPAPAPAPA***MVSKGEEDNMAIIKEFMRFKVHMEGSVNGHEFEIEGEGEGRPYEGTQTAKL
KVTKGGPLPFAWDILSPQFMYGSKAYVKHPADIPDYLKLSFPEGFKWERVMNFEDGGVVTVTQDSSLQDGEFIYKV
KLRGTNFPSDGPVMQKKTMGWEASSERMYPEDGALKGEIKQRLKLKDGGHYDAEVKTTYKAKKPVQLPGAYNVNIK
LDITSHNEDYTIVEQYERAEGRHSTGGMDELYK***

SEQ ID NO: 89
MDKKYSIGLDIGTNSVGWAVITDEYKVPSKKFKVLGNTDRHSIKKNLIGALLFDSGETAEATRLKRTARRRYTRRK
NRICYLQEIFSNEMAKVDDSFFHRLEESFLVEEDKKHERHPIFGNIVDEVAYHEKYPTIYHLRKKLVDSTDKADLR

TABLE V.2-continued

Cas9-Linker-mCherryChimeras

LIYLALAHMIKFRGHFLIEGDLNPDNSDVDKLFIQLVQTYNQLFEENPINASGVDAKAILSARLSKSRRLENLIAQ
LPGEKKNGLFGNLIALSLGLTPNFKSNFDLAEDAKLQLSKDTYDDDLDNLLAQIGDQYADLFLAAKNLSDAILLSD
ILRVNTEITKAPLSASMIKRYDEHHQDLTLLKALVRQQLPEKYKEIFFDQSKNGYAGYIDGGASQEEFYKFIKPIL
EKMDGTEELLVKLNREDLLRKQRTFDNGSIPHQIHLGELHAILRRQEDFYPFLKDNREKIEKILTFRIPYYVGPLA
RGNSRFAWMTRKSEETITPWNFEEVVDKGASAQSFIERMTNFDKNLPNEKVLPKHSLLYEYFTVYNELTKVKYTE
GMRKPAFLSGEQKKAIVDLLFKTNRKVTVKQLKEDYFKKIECFDSVEISGVEDRFNASLGTYHDLLKIIKDKDFLD
NEENEDILEDIVLTLTLFEDREMIEERLKTYAHLFDDKVMKQLKRRRYTGWGRLSRKLINGIRDKQSGKTILDFLK
SDGFANRNFMQLIHDDSLTFKEDIQKAQVSGQGDSLHEHIANLAGSPAIKKGILQTVKVVDELVKVMGRHKPENIV
IEMARENQTTQKGQKNSRERMKRIEEGIKELGSQILKEHPVENTQLQNEKLYLYYLQNGRDMYVDQELDINRLSDY
DVDHIVPQSFLKDDSIDNKVLTRSDKNRGKSDNVPSEEVVKKMKNYWRQLLNAKLITQRKFDNLTKAERGGLSELD
KAGFIKRQLVETRQITKHVAQILDSRMNTKYDENDKLIREVKVITLKSKLVSDFRKDFQFYKVREINNYHHAHDAY
LNAVVGTALIKKYPKLESEFVYGDYKVYDVRKMIAKSEQEIGKATAKYFFYSNIMNFFKTEITLANGEIRKRPLIE
TNGETGEIVWDKGRDFATVRKVLSMPQVNIVKKTEVQTGGFSKESILPKRNSDKLIARKKDWDPKKYGGFDSPTVA
YSVLVVAKVEKGKSKKLKSVKELLGITIMERSSFEKNPIDFLEAKGYKEVKKDLIIKLPKYSLFELENGRKRMLAS
AGELQKGNELALPSKYVNFLYLASHYEKLKGSPEDNEQKQLFVEQHKHYLDEIIEQISEFSKRVILADANLDKVLS
AYNKHRDKPIREQAENIIHLFTLTNLGAPAAFKYFDTTIDRKRYTSTKEVLDATLIHQSITGLYETRIDLSQLGGD
APAPAPAPAPAPAPAPAPAPAPAPAPA*MVSKGEEDNMAIIKEFMRFKVHMEGSVNGHEFEIEGEGEGRPYEGTQTA
KLKVTKGGPLPFAWDILSPQFMYGSKAYVKHPADIPDYLKLSFPEGFKWERVMNFDGGVVTVTQDSSLQDGEFIY
KVKLRGTNFPSDGPVMQKKTMGWEASSERMYPEDGALKGEIKQRLKLKDGGHYDAEVKTTYKAKKPVQLPGAYNVN
IKLDITSHNEDYTIVEQYERAEGRHSTGGMDELYK*

SEQ ID NO: 90
MDKKYSIGLDIGTNSVGWAVITDEYKVPSKKFKVLGNTDRHSIKKNLIGALLFDSGETAEATRLKRTARRRYTRRK
NRICYLQEIFSNEMAKVDDSFFHRLEESFLVEEDKKHERHPIFGNIVDEVAYHEKYPTIYHLRKKLVDSTDKADLR
LIYLALAHMIKFRGHFLIEGDLNPDNSDVDKLFIQLVQTYNQLFEENPINASGVDAKAILSARLSKSRRLENLIAQ
LPGEKKNGLFGNLIALSLGLTPNFKSNFDLAEDAKLQLSKDTYDDDLDNLLAQIGDQYADLFLAAKNLSDAILLSD
ILRVNTEITKAPLSASMIKRYDEHHQDLTLLKALVRQQLPEKYKEIFFDQSKNGYAGYIDGGASQEEFYKFIKPIL
EKMDGTEELLVKLNREDLLRKQRTFDNGSIPHQIHLGELHAILRRQEDFYPFLKDNREKIEKILTFRIPYYVGPLA
RGNSRFAWMTRKSEETITPWNFEEVVDKGASAQSFIERMTNFDKNLPNEKVLPKHSLLYEYFTVYNELTKVKYTE
GMRKPAFLSGEQKKAIVDLLFKTNRKVTVKQLKEDYFKKIECFDSVEISGVEDRFNASLGTYHDLLKIIKDKDFLD
NEENEDILEDIVLTLTLFEDREMIEERLKTYAHLFDDKVMKQLKRRRYTGWGRLSRKLINGIRDKQSGKTILDFLK
SDGFANRNFMQLIHDDSLTFKEDIQKAQVSGQGDSLHEHIANLAGSPAIKKGILQTVKVVDELVKVMGRHKPENIV
IEMARENQTTQKGQKNSRERMKRIEEGIKELGSQILKEHPVENTQLQNEKLYLYYLQNGRDMYVDQELDINRLSDY
DVDHIVPQSFLKDDSIDNKVLTRSDKNRGKSDNVPSEEVVKKMKNYWRQLLNAKLITQRKFDNLTKAERGGLSELD
KAGFIKRQLVETRQITKHVAQILDSRMNTKYDENDKLIREVKVITLKSKLVSDFRKDFQFYKVREINNYHHAHDAY
LNAVVGTALIKKYPKLESEFVYGDYKVYDVRKMIAKSEQEIGKATAKYFFYSNIMNFFKTEITLANGEIRKRPLIE
TNGETGEIVWDKGRDFATVRKVLSMPQVNIVKKTEVQTGGFSKESILPKRNSDKLIARKKDWDPKKYGGFDSPTVA
YSVLVVAKVEKGKSKKLKSVKELLGITIMERSSFEKNPIDFLEAKGYKEVKKDLIIKLPKYSLFELENGRKRMLAS
AGELQKGNELALPSKYVNFLYLASHYEKLKGSPEDNEQKQLFVEQHKHYLDEIIEQISEFSKRVILADANLDKVLS
AYNKHRDKPIREQAENIIHLFTLTNLGAPAAFKYFDTTIDRKRYTSTKEVLDATLIHQSITGLYETRIDLSQLGGD
APAPAPAPAPAPAPAPAPAPAPAPAPA*MVSKGEEDNMAIIKEFMRFKVHMEGSVNGHEFEIEGEGEGRPYEGTQ
TAKLKVTKGGPLPFAWDILSPQFMYGSKAYVKHPADIPDYLKLSFPEGFKWERVMNFEDGGVVTVTQDSSLQDGEF
IYKVKLRGTNFPSDGPVMQKKTMGWEASSERMYPEDGALKGEIKQRLKLKDGGHYDAEVKTTYKAKKPVQLPGAYN
VNIKLDITSHNEDYTIVEQYERAEGRHSTGGMDELYK*

SEQ ID NO: 91
MDKKYSIGLDIGTNSVGWAVITDEYKVPSKKFKVLGNTDRHSIKKNLIGALLFDSGETAEATRLKRTARRRYTRRK
NRICYLQEIFSNEMAKVDDSFFHRLEESFLVEEDKKHERHPIFGNIVDEVAYHEKYPTIYHLRKKLVDSTDKADLR
LIYLALAHMIKFRGHFLIEGDLNPDNSDVDKLFIQLVQTYNQLFEENPINASGVDAKAILSARLSKSRRLENLIAQ
LPGEKKNGLFGNLIALSLGLTPNFKSNFDLAEDAKLQLSKDTYDDDLDNLLAQIGDQYADLFLAAKNLSDAILLSD
ILRVNTEITKAPLSASMIKRYDEHHQDLTLLKALVRQQLPEKYKEIFFDQSKNGYAGYIDGGASQEEFYKFIKPIL
EKMDGTEELLVKLNREDLLRKQRTFDNGSIPHQIHLGELHAILRRQEDFYPFLKDNREKIEKILTFRIPYYVGPLA
RGNSRFAWMTRKSEETITPWNFEEVVDKGASAQSFIERMTNFDKNLPNEKVLPKHSLLYEYFTVYNELTKVKYTE
GMRKPAFLSGEQKKAIVDLLFKTNRKVTVKQLKEDYFKKIECFDSVEISGVEDRFNASLGTYHDLLKIIKDKDFLD
NEENEDILEDIVLTLTLFEDREMIEERLKTYAHLFDDKVMKQLKRRRYTGWGRLSRKLINGIRDKQSGKTILDFLK
SDGFANRNFMQLIHDDSLTFKEDIQKAQVSGQGDSLHEHIANLAGSPAIKKGILQTVKVVDELVKVMGRHKPENIV
IEMARENQTTQKGQKNSRERMKRIEEGIKELGSQILKEHPVENTQLQNEKLYLYYLQNGRDMYVDQELDINRLSDY
DVDHIVPQSFLKDDSIDNKVLTRSDKNRGKSDNVPSEEVVKKMKNYWRQLLNAKLITQRKFDNLTKAERGGLSELD
KAGFIKRQLVETRQITKHVAQILDSRMNTKYDENDKLIREVKVITLKSKLVSDFRKDFQFYKVREINNYHHAHDAY
LNAVVGTALIKKYPKLESEFVYGDYKVYDVRKMIAKSEQEIGKATAKYFFYSNIMNFFKTEITLANGEIRKRPLIE
TNGETGEIVWDKGRDFATVRKVLSMPQVNIVKKTEVQTGGFSKESILPKRNSDKLIARKKDWDPKKYGGFDSPTVA
YSVLVVAKVEKGKSKKLKSVKELLGITIMERSSFEKNPIDFLEAKGYKEVKKDLIIKLPKYSLFELENGRKRMLAS
AGELQKGNELALPSKYVNFLYLASHYEKLKGSPEDNEQKQLFVEQHKHYLDEIIEQISEFSKRVILADANLDKVLS
AYNKHRDKPIREQAENIIHLFTLTNLGAPAAFKYFDTTIDRKRYTSTKEVLDATLIHQSITGLYETRIDLSQLGGD
X*PMVSKGEEDNMAIIKEFMRFKVHMEGSVNGHEFEIEGEGEGRPYEGTQTAKLKVTKGGPLPFAWDILSPQFMYGS
KAYVKHPADIPDYLKLSFPEGFKWERVMNFEDGGVVTVTQDSSLQDGEFIYKVKLRGTNFPSDGPVMQKKTMGWEA
SSERMYPEDGALKGEIKQRLKLKDGGHYDAEVKTTYKAKKPVQLPGAYNVNIKLDITSHNEDYTIVEQYERAEGRH
STGGMDELYK*

SEQ ID NO: 92
MDKKYSIGLDIGTNSVGWAVITDEYKVPSKKFKVLGNTDRHSIKKNLIGALLFDSGETAEATRLKRTARRRYTRRK
NRICYLQEIFSNEMAKVDDSFFHRLEESFLVEEDKKHERHPIFGNIVDEVAYHEKYPTIYHLRKKLVDSTDKADLR
LIYLALAHMIKFRGHFLIEGDLNPDNSDVDKLFIQLVQTYNQLFEENPINASGVDAKAILSARLSKSRRLENLIAQ
LPGEKKNGLFGNLIALSLGLTPNFKSNFDLAEDAKLQLSKDTYDDDLDNLLAQIGDQYADLFLAAKNLSDAILLSD
ILRVNTEITKAPLSASMIKRYDEHHQDLTLLKALVRQQLPEKYKEIFFDQSKNGYAGYIDGGASQEEFYKFIKPIL
EKMDGTEELLVKLNREDLLRKQRTFDNGSIPHQIHLGELHAILRRQEDFYPFLKDNREKIEKILTFRIPYYVGPLA
RGNSRFAWMTRKSEETITPWNFEEVVDKGASAQSFIERMTNFDKNLPNEKVLPKHSLLYEYFTVYNELTKVKYTE
GMRKPAFLSGEQKKAIVDLLFKTNRKVTVKQLKEDYFKKIECFDSVEISGVEDRFNASLGTYHDLLKIIKDKDFLD

TABLE V.2-continued

Cas9-Linker-mCherryChimeras

NEENEDILEDIVLTLTLFEDREMIEERLKTYAHLFDDKVMKQLKRRRYTGWGRLSRKLINGIRDKQSGKTILDFLK
SDGFANRNFMQLIHDDSLTFKEDIQKAQVSGQGDSLHEHIANLAGSPAIKKGILQTVKVVDELVKVMGRHKPENIV
IEMARENQTTQKGQKNSRERMKRIEEGIKELGSQILKEHPVENTQLQNEKLYLYYLQNGRDMYVDQELDINRLSDY
DVDHIVPQSFLKDDSIDNKVLTRSDKNRGKSDNVPSEEVVKKMKNYWRQLLNAKLITQRKFDNLTKAERGGLSELD
KAGFIKRQLVETRQITKHVAQILDSRMNTKYDENDKLIREVKVITLKSKLVSDFRKDFQFYKVREINNYHHAHDAY
LNAVVGTALIKKYPKLESEFVYGDYKVYDVRKMIAKSEQEIGKATAKYFFYSNIMNFFKTEITLANGEIRKRPLIE
TNGETGEIVWDKGRDFATVRKVLSMPQVNIVKKTEVQTGGFSKESILPKRNSDKLIARKKDWDPKKYGGFDSPTVA
YSVLVVAKVEKGKSKKLKSVKELLGITIMERSSFEKNPIDFLEAKGYKEVKKDLIIKLPKYSLFELENGRKRMLAS
AGELQKGNELALPSKYVNFLYLASHYEKLKGSPEDNEQKQLFVEQHKYLDEIIEQISEFSKRVILADANLDKVLS
AYNKHRDKPIREQAENIIHLFTLTNLGAPAAFKYFDTTIDRKRYTSTKEVLDATLIHQSITGLYETRIDLSQLGGD
XPXP*MVSKGEEDNMAIIKEFMRFKVHMEGSVNGHEFEIEGEGEGRPYEGTQTAKIKVTKGGPLPFAWDILSPQFMY*
*GSKAYVKHPADIPDYLKLSFPEGFKWERVMNFEDGGVVTVTQDSSLQDGEFIYKVKLRGTNFPSDGPVMQKKTMGW*
*EASSERMYPEDGALKGEIKQRLKLKDGGHYDAEVKTTYKAKKPVQLPGAYNVNIKLDITSHNEDYTIVEQYERAEG*
*RHSTGGMDELYK*

SEQ ID NO: 93
MDKKYSIGLDIGTNSVGWAVITDEYKVPSKKFKVLGNTDRHSIKKNLIGALLFDSGETAEATRLKRTARRRYTRRK
NRICYLQEIFSNEMAKVDDSFFHRLEESFLVEEDKKHERHPIFGNIVDEVAYHEKYPTIYHLRKKLVDSTDKADLR
LIYLALAHMIKFRGHFLIEGDLNPDNSDVDKLFIQLVQTYNQLFEENPINASGVDAKAILSARLSKSRRLENLIAQ
LPGEKKNGLFGNLIALSLGLTPNFKSNFDLAEDAKLQLSKDTYDDDLDNLLAQIGDQYADLFLAAKNLSDAILLSD
ILRVNTEITKAPLSASMIKRYDEHHQDLTLLKALVRQQLPEKYKEIFFDQSKNGYAGYIDGGASQEEFYKFIKPIL
EKMDGTEELLVKLNREDLLRKQRTFDNGSIPHQIHLGELHAILRRQEDFYPFLKDNREKIEKILTFRIPYYVGPLA
RGNSRFAWMTRKSEETITPWNFEEVVDKGASAQSFIERMTNFDKNLPNEKVLPKHSLLYEYFTVYNELTKVKYVTE
GMRKPAFLSGEQKKAIVDLLFKTNRKVTVKQLKEDYFKKIECFDSVEISGVEDRFNASLGTYHDLLKIIKDKDFLD
NEENEDILEDIVLTLTLFEDREMIEERLKTYAHLFDDKVMKQLKRRRYTGWGRLSRKLINGIRDKQSGKTILDFLK
SDGFANRNFMQLIHDDSLTFKEDIQKAQVSGQGDSLHEHIANLAGSPAIKKGILQTVKVVDELVKVMGRHKPENIV
IEMARENQTTQKGQKNSRERMKRIEEGIKELGSQILKEHPVENTQLQNEKLYLYYLQNGRDMYVDQELDINRLSDY
DVDHIVPQSFLKDDSIDNKVLTRSDKNRGKSDNVPSEEVVKKMKNYWRQLLNAKLITQRKFDNLTKAERGGLSELD
KAGFIKRQLVETRQITKHVAQILDSRMNTKYDENDKLIREVKVITLKSKLVSDFRKDFQFYKVREINNYHHAHDAY
LNAVVGTALIKKYPKLESEFVYGDYKVYDVRKMIAKSEQEIGKATAKYFFYSNIMNFFKTEITLANGEIRKRPLIE
TNGETGEIVWDKGRDFATVRKVLSMPQVNIVKKTEVQTGGFSKESILPKRNSDKLIARKKDWDPKKYGGFDSPTVA
YSVLVVAKVEKGKSKKLKSVKELLGITIMERSSFEKNPIDFLEAKGYKEVKKDLIIKLPKYSLFELENGRKRMLAS
AGELQKGNELALPSKYVNFLYLASHYEKLKGSPEDNEQKQLFVEQHKYLDEIIEQISEFSKRVILADANLDKVLS
AYNKHRDKPIREQAENIIHLFTLINLGAPAAFKYFDTTIDRKRYTSTKEVLDATLIHQSITGLYETRIDLSQLGGD
XPXPXP*MVSKGEEDNMAIIKEFMRFKVHMEGSVNGHEFEIEGEGEGRPYEGTQTAKLKVTKGGPLPFAWDILSPQF*
*MYGSKAYVKHPADIPDYKLSFPEGFKWERVMNFEDGGVVTVTQDSSLQDGEFIYKVKLRGTNFPSDGPVMQKKTM*
*GWEASSERMYPEDGALKGEIKQRLKLKDGGHYDAEVKTTYKAKKPVQLPGAYNVNIKLDITSHNEDYTIVEQYERA*
*EGRHSTGGMDELYK*

SEQ ID NO: 94
MDKKYSIGLDIGTNSVGWAVITDEYKVPSKKFKVLGNTDRHSIKKNLIGALLFDSGETAEATRLKRTARRRYTRRK
NRICYLQEIFSNEMAKVDDSFFHRLEESFLVEEDKKHERHPIFGNIVDEVAYHEKYPTIYHLRKKLVDSTDKADLR
LIYLALAHMIKFRGHFLIEGDLNPDNSDVDKLFIQLVQTYNQLFEENPINASGVDAKAILSARLSKSRRLENLIAQ
LPGEKKNGLFGNLIALSLGLTPNFKSNFDLAEDAKLQLSKDTYDDDLDNLLAQIGDQYADLFLAAKNLSDAILLSD
ILRVNTEITKAPLSASMIKRYDEHHQDLTLLKALVRQQLPEKYKEIFFDQSKNGYAGYIDGGASQEEFYKFIKPIL
EKMDGTEELLVKLNREDLLRKQRTFDNGSIPHQIHLGELHAILRRQEDFYPFLKDNREKIEKILTFRIPYYVGPLA
RGNSRFAWMTRKSEETITPWNFEEVVDKGASAQSFIERMTNFDKNLPNEKVLPKHSLLYEYFTVYNELTKVKYVTE
GMRKPAFLSGEQKKAIVDLLFKTNRKVTVKQLKEDYFKKIECFDSVEISGVEDRFNASLGTYHDLLKIIKDKDFLD
NEENEDILEDIVLTLTLFEDREMIEERLKTYAHLFDDKVMKQLKRRRYTGWGRLSRKLINGIRDKQSGKTILDFLK
SDGFANRNFMQLIHDDSLTFKEDIQKAQVSGQGDSLHEHIANLAGSPAIKKGILQTVKVVDELVKVMGRHKPENIV
IEMARENQTTQKGQKNSRERMKRIEEGIKELGSQILKEHPVENTQLQNEKLYLYYLQNGRDMYVDQELDINRLSDY
DVDHIVPQSFLKDDSIDNKVLTRSDKNRGKSDNVPSEEVVKKMKNYWRQLLNAKLITQRKFDNLTKAERGGLSELD
KAGFIKRQLVETRQITKHVAQILDSRMNTKYDENDKLIREVKVITLKSKLVSDFRKDFQFYKVREINNYHHAHDAY
LNAVVGTALIKKYPKLESEFVYGDYKVYDVRKMIAKSEQEIGKATAKYFFYSNIMNFFKTEITLANGEIRKRPLIE
TNGETGEIVWDKGRDFATVRKVLSMPQVNIVKKTEVQTGGFSKESILPKRNSDKLIARKKDWDPKKYGGFDSPTVA
YSVLVVAKVEKGKSKKLKSVKELLGITIMERSSFEKNPIDFLEAKGYKEVKKDLIIKLPKYSLFELENGRKRMLAS
AGELQKGNELALPSKYVNFLYLASHYEKLKGSPEDNEQKQLFVEQHKYLDEIIEQISEFSKRVILADANLDKVLS
AYNKHRDKPIREQAENIIHLFTLINLGAPAAFKYFDTTIDRKRYTSTKEVLDATLIHQSITGLYETRIDLSQLGGD
XPXPXPXP*MVSKGEEDNMAIIKEFMRFKVHMEGSVNGHEFEIEGEGEGRPYEGTQTAKLKVTKGGPLPFAWDILSP*
*QFMYGSKAYVKHPADIPDYLKLSFPEGFKWERVMNFEDGGVVTVTQDSSLQDGEFIYKVKLRGTNFPSDGPVMQKK*
*TMGWEASSERMYPEDGALKGEIKQRLKIKDGGHYDAEVKTTYKAKKPVQLPGAYNVNIKLDITSHNEDYTIVEQYE*
*RAEGRHSTGGMDELYK*

SEQ ID NO: 95
MDKKYSIGLDIGTNSVGWAVITDEYKVPSKKFKVLGNTDRHSIKKNLIGALLFDSGETAEATRLKRTARRRYTRRK
NRICYLQEIFSNEMAKVDDSFFHRLEESFLVEEDKKHERHPIFGNIVDEVAYHEKYPTIYHLRKKLVDSTDKADLR
LIYLALAHMIKFRGHFLIEGDLNPDNSDVDKLFIQLVQTYNQLFEENPINASGVDAKAILSARLSKSRRLENLIAQ
LPGEKKNGLFGNLIALSLGLTPNFKSNFDLAEDAKLQLSKDTYDDDLDNLLAQIGDQYADLFLAAKNLSDAILLSD
ILRVNTEITKAPLSASMIKRYDEHHQDLTLLKALVRQQLPEKYKEIFFDQSKNGYAGYIDGGASQEEFYKFIKPIL
EKMDGTEELLVKLNREDLLRKQRTFDNGSIPHQIHLGELHAILRRQEDFYPFLKDNREKIEKILTFRIPYYVGPLA
RGNSRFAWMTRKSEETITPWNFEEVVDKGASAQSFIERMTNFDKNLPNEKVLPKHSLLYEYFTVYNELTKVKYVTE
GMRKPAFLSGEQKKAIVDLLFKTNRKVTVKQLKEDYFKKIECFDSVEISGVEDRFNASLGTYHDLLKIIKDKDFLD
NEENEDILEDIVLTLTLFEDREMIEERLKTYAHLFDDKVMKQLKRRRYTGWGRLSRKLINGIRDKQSGKTILDFLK
SDGFANRNFMQLIHDDSLTFKEDIQKAQVSGQGDSLHEHIANLAGSPAIKKGILQTVKVVDELVKVMGRHKPENIV
IEMARENQTTQKGQKNSRERMKRIEEGIKELGSQILKEHPVENTQLQNEKLYLYYLQNGRDMYVDQELDINRLSDY
DVDHIVPQSFLKDDSIDNKVLTRSDKNRGKSDNVPSEEVVKKMKNYWRQLLNAKLITQRKFDNLTKAERGGLSELD
KAGFIKRQLVETRQITKHVAQILDSRMNTKYDENDKLIREVKVITLKSKLVSDFRKDFQFYKVREINNYHHAHDAY
LNAVVGTALIKKYPKLESEFVYGDYKVYDVRKMIAKSEQEIGKATAKYFFYSNIMNFFKTEITLANGEIRKRPLIE

TABLE V.2-continued

Cas9-Linker-mCherryChimeras

TNGETGEIVWDKGRDFATVRKVLSMPQVNIVKKTEVQTGGFSKESILPKRNSDKLIARKKDWDPKKYGGFDSPTVA
YSVLVVAKVEKGKSKKLKSVKELLGITIMERSSFEKNPIDFLEAKGYKEVKKDLIIKLPKYSLFELENGRKRMLAS
AGELQKGNELALPSKYVNFLYLASHYEKLKGSPEDNEQKQLFVEQHKHYLDEIIEQISEFSKRVILADANLDKVLS
AYNKHRDKPIREQAENIIHLFTLINLGAPAAFKYFDTTIDRKRYTSTKEVLDATLIHQSITGLYETRIDLSQLGGD
XPXPXPXPX*MVSKGEEDNMAIIKEFMRFKVHMEGSVNGHEFEIEGEGEGRPYEGTQTAKLKVTKGGPLPFAWDIL*
*SPQFMYGSKAYVKHPADIPDYLKLSFPEGFKWERVMNFEDGGVVTVTQDSSLQDGEFIYKVKLRGTNFPSDGPVMQ*
*KKTMGWEASSERMYPEDGALKGEIKQRLKLKDGGHYDAEVKTTYKAKKPVQLPGAYNVNIKLDITSHNEDYTIVEQ*
*YERAEGRHSTGGMDELYK*

SEQ ID NO: 96
MDKKYSIGLDIGTNSVGWAVITDEYKVPSKKFKVLGNTDRHSIKKNLIGALLFDSGETAEATRLKRTARRRYTRRK
NRICYLQEIFSNEMAKVDDSFFHRLEESFLVEEDKKHERHPIFGNIVDEVAYHEKYPTIYHLRKKLVDSTDKADLR
LIYLALAHMIKFRGHFLIEGDLNPDNSDVDKLFIQLVQTYNQLFEENPINASGVDAKAILSARLSKSRRLENLIAQ
LPGEKKNGLFGNLIALSLGLTPNFKSNFDLAEDAKLQLSKDTYDDDLDNLLAQIGDQYADLFLAAKNLSDAILLSD
ILRVNTEITKAPLSASMIKRYDEHHQDLTLLKALVRQQLPEKYKEIFFDSKNGYAGYIDGGASQEEFYKFIKPIL
EKMDGTEELLVKLNREDLLRKQRTFDNGSIPHQIHLGELHAILRRQEDFYPFLKDNREKIEKILTFRIPYYVGPLA
RGNSRFAWMTRKSEETITPWNFEEVVDKGASAQSFIERMTNFDKNLPNEKVLPKHSLLYEYFTVYNELTKVKYTE
GMRKPAFLSGEQKKAIVDLLFKTNRKVTVKQLKEDYFKKIECFDSVEISGVEDRFNASLGTYHDLLKIIKDKDFLD
NEENEDILEDIVLTLTLFEDREMIEERLKTYAHLFDDKVMKQLKRRRYTGWGRLSRKLINGIRDKQSGKTILDFLK
SDGFANRNFMQLIHDDSLTFKEDIQKAQVSGQGDSLHEHIANLAGSPAIKKGILQTVKVVDELVKVMGRHKPENIV
IEMARENQTTQKGQKNSRERMKRIEEGIKELGSQILKEHPVENTQLQNEKLYLYYLQNGRDMYVDQELDINRLSDY
DVDHIVPQSFLKDDSIDNKVLTRSDKNRGKSDNVPSEEVVKKMKNYWRQLLNAKLITQRKFDNLTKAERGGLSELD
KAGFIKRQLVETRQITKHVAQILDSRMNTKYDENDKLIREVKVITLKSKLVSDFRKDFQFYKVREINNYHHAHDAY
LNAVVGTALIKKYPKLESEFVYGDYKVYDVRKMIAKSEQEIGKATAKYFFYSNIMNFFKTEITLANGEIRKRPLIE
TNGETGEIVWDKGRDFATVRKVLSMPQVNIVKKTEVQTGGFSKESILPKRNSDKLIARKKDWDPKKYGGFDSPTVA
YSVLVVAKVEKGKSKKLKSVKELLGITIMERSSFEKNPIDFLEAKGYKEVKKDLIIKLPKYSLFELENGRKRMLAS
AGELQKGNELALPSKYVNFLYLASHYEKLKGSPEDNEQKQLFVEQHKHYLDEIIEQISEFSKRVILADANLDKVLS
AYNKHRDKPIREQAENIIHLFTLINLGAPAAFKYFDTTIDRKRYTSTKEVLDATLIHQSITGLYETRIDLSQLGGD
XPXPXPXPXPX*MVSKGEEDNMAIIKEFMRFKVHMEGSVNGHEFEIEGEGEGRPYEGTQTAKLKVTKGGPLPFAWD*
*ILSPQFMYGSKAYVKHPADIPDYLKLSFPEGFKWERVMNFEDGGVVTVTQDSSLQDGEFIYKVKLRGTNFPSDGPV*
*MQKKTMGWEASSERMYPEDGALKGEIKQRLKLKDGGHYDAEVKTTYKAKKPVQLPGAYNVNIKLDITSHNEDYTIV*
*EQYERAEGRHSTGGMDELYK*

SEQ ID NO: 97
MDKKYSIGLDIGTNSVGWAVITDEYKVPSKKFKVLGNTDRHSIKKNLIGALLFDSGETAEATRLKRTARRRYTRRK
NRICYLQEIFSNEMAKVDDSFFHRLEESFLVEEDKKHERHPIFGNIVDEVAYHEKYPTIYHLRKKLVDSTDKADLR
LIYLALAHMIKFRGHFLIEGDLNPDNSDVDKLFIQLVQTYNQLFEENPINASGVDAKAILSARLSKSRRLENLIAQ
LPGEKKNGLFGNLIALSLGLTPNFKSNFDLAEDAKLQLSKDTYDDDLDNLLAQIGDQYADLFLAAKNLSDAILLSD
ILRVNTEITKAPLSASMIKRYDEHHQDLTLLKALVRQQLPEKYKEIFFDQSKNGYAGYIDGGASQEEFYKFIKPIL
EKMDGTEELLVKLNREDLLRKQRTFDNGSIPHQIHLGELHAILRRQEDFYPFLKDNREKIEKILTFRIPYYVGPLA
RGNSRFAWMTRKSEETITPWNFEEVVDKGASAQSFIERMTNFDKNLPNEKVLPKHSLLYEYFTVYNELTKVKYTE
GMRKPAFLSGEQKKAIVDLLFKTNRKVTVKQLKEDYFKKIECFDSVEISGVEDRFNASLGTYHDLLKIIKDKDFLD
NEENEDILEDIVLTLTLFEDREMIEERLKTYAHLFDDKVMKQLKRRRYTGWGRLSRKLINGIRDKQSGKTILDFLK
SDGFANRNFMQLIHDDSLTFKEDIQKAQVSGQGDSLHEHIANLAGSPAIKKGILQTVKVVDELVKVMGRHKPENIV
IEMARENQTTQKGQKNSRERMKRIEEGIKELGSQILKEHPVENTQLQNEKLYLYYLQNGRDMYVDQELDINRLSDY
DVDHIVPQSFLKDDSIDNKVLTRSDKNRGKSDNVPSEEVVKKMKNYWRQLLNAKLITQRKFDNLTKAERGGLSELD
KAGFIKRQLVETRQITKHVAQILDSRMNTKYDENDKLIREVKVITLKSKLVSDFRKDFQFYKVREINNYHHAHDAY
LNAVVGTALIKKYPKLESEFVYGDYKVYDVRKMIAKSEQEIGKATAKYFFYSNIMNFFKTEITLANGEIRKRPLIE
TNGETGEIVWDKGRDFATVRKVLSMPQVNIVKKTEVQTGGFSKESILPKRNSDKLIARKKDWDPKKYGGFDSPTVA
YSVLVVAKVEKGKSKKLKSVKELLGITIMERSSFEKNPIDFLEAKGYKEVKKDLIIKLPKYSLFELENGRKRMLAS
AGELQKGNELALPSKYVNFLYLASHYEKLKGSPEDNEQKQLFVEQHKHYLDEIIEQISEFSKRVILADANLDKVLS
AYNKHRDKPIREQAENIIHLFTLNLGAPAAFKYFDTTIDRKRYTSTKEVLDATLIHQSITGLYETRIDLSQLGGD
XPXPXPXPXPXP*MVSKGEEDNMAIIKEFMRFKVHMEGSVNGHEFEIEGEGEGRPYEGTQTAKLKVTKGGPLPFA*
*WDILSPQFMYGSKAYVKHPADIPDYLKLSFPEGFKWERVMNFEDGGVVTVTQDSSLQDGEFIYKVKLRGTNFPSDG*
*PVMQKKTMGWEASSERMYPEDGALKGEIKQRLKLKDGGHYDAEVKTTYKAKKPVQLPGAYNVNIKLDITSHNEDYT*
*IVEQYERAEGRHSTGGMDELYK*

SEQ ID NO: 98
MDKKYSIGLDIGTNSVGWAVITDEYKVPSKKFKVLGNTDRHSIKKNLIGALLFDSGETAEATRLKRTARRRYTRRK
NRICYLQEIFSNEMAKVDDSFFHRLEESFLVEEDKKHERHPIFGNIVDEVAYHEKYPTIYHLRKKLVDSTDKADLR
LIYLALAHMIKFRGHFLIEGDLNPDNSDVDKLFIQLVQTYNQLFEENPINASGVDAKAILSARLSKSRRLENLIAQ
LPGEKKNGLFGNLIALSLGLTPNFKSNFDLAEDAKLQLSKDTYDDDLDNLLAQIGDQYADLFLAAKNLSDAILLSD
ILRVNTEITKAPLSASMIKRYDEHHQDLTLLKALVRQQLPEKYKEIFFDQSKNGYAGYIDGGASQEEFYKFIKPIL
EKMDGTEELLVKLNREDLLRKQRTFDNGSIPHQIHLGELHAILRRQEDFYPFLKDNREKIEKILTFRIPYYVGPLA
RGNSRFAWMTRKSEETITPWNFEEVVDKGASAQSFIERMTNFDKNLPNEKVLPKHSLLYEYFTVYNELTKVKYTE
GMRKPAFLSGEQKKAIVDLLFKTNRKVTVKQLKEDYFKKIECFDSVEISGVEDRFNASLGTYHDLLKIIKDKDFLD
NEENEDILEDIVLTLTLFEDREMIEERLKTYAHLFDDKVMKQLKRRRYTGWGRLSRKLINGIRDKQSGKTILDFLK
SDGFANRNFMQLIHDDSLTFKEDIQKAQVSGQGDSLHEHIANLAGSPAIKKGILQTVKVVDELVKVMGRHKPENIV
IEMARENQTTQKGQKNSRERMKRIEEGIKELGSQILKEHPVENTQLQNEKLYLYYLQNGRDMYVDQELDINRLSDY
DVDHIVPQSFLKDDSIDNKVLTRSDKNRGKSDNVPSEEVVKKMKNYWRQLLNAKLITQRKFDNLTKAERGGLSELD
KAGFIKRQLVETRQITKHVAQILDSRMNTKYDENDKLIREVKVITLKSKLVSDFRKDFQFYKVREINNYHHAHDAY
LNAVVGTALIKKYPKLESEFVYGDYKVYDVRKMIAKSEQEIGKATAKYFFYSNIMNFFKTEITLANGEIRKRPLIE
TNGETGEIVWDKGRDFATVRKVLSMPQVNIVKKTEVQTGGFSKESILPKRNSDKLIARKKDWDPKKYGGFDSPTVA
YSVLVVAKVEKGKSKKLKSVKELLGITIMERSSFEKNPIDFLEAKGYKEVKKDLIIKLPKYSLFELENGRKRMLAS
AGELQKGNELALPSKYVNFLYLASHYEKLKGSPEDNEQKQLFVEQHKHYLDEIIEQISEFSKRVILADANLDKVLS
AYNKHRDKPIREQAENIIHLFTLNLGAPAAFKYFDTTIDRKRYTSTKEVLDATLIHQSITGLYETRIDLSQLGGD
XPXPXPXPXPXPX*MVSKGEEDNMAIIKEFMRFKVHMEGSVNGHEFEIEGEGEGRPYEGTQTAKLKVTKGGPLP*
*FAWILSPQFMYGSKAYVKHPADIPDYLKLSFPEGFKWERVMNFEDGGVVTVTQDSSLQDGEFIYKVKLRGTNFPS*

TABLE V.2-continued

Cas9-Linker-mCherryChimeras

*DGPVMQKKTMGWEASSERMYPEDGALKGEIKQRLKLKDGGHYDAEVKTTYKAKKPVQLPGAYNVNIKLDITSHNED*
*YTIVEQYERAEGRHSTGGMDELYK*

SEQ ID NO: 99
MDKKYSIGLDIGTNSVGWAVITDEYKVPSKKFKVLGNTDRHSIKKNLIGALLFDSGETAEATRLKRTARRRYTRRK
NRICYLQEIFSNEMAKVDDSFFHRLEESFLVEEDKKHERHPIFGNIVDEVAYHEKYPTIYHLRKKLVDSTDKADLR
LIYLALAHMIKFRGHFLIEGDLNPDNSDVDKLFIQLVQTYNQLFEENPINASGVDAKAILSARLSKSRRLENLIAQ
LPGEKKNGLFGNLIALSLGLTPNFKSNFDLAEDAKLQLSKDTYDDDLDNLLAQIGDQYADLFLAAKNLSDAILLSD
ILRVNTEITKAPLSASMIKRYDEHHQDLTLLKALVRQQLPEKYKEIFFDQSKNGYAGYIDGGASQEEFYKFIKPIL
EKMDGTEELLVKLNREDLLRKQRTFDNGSIPHQIHLGELHAILRRQEDFYPFLKDNREKIEKILTFRIPYYVGPLA
RGNSRFAWMTRKSEETITPWNFEEVVDKGASAQSFIERMTNFDKNLPNEKVLPKHSLLYEYFTVYNELTKVKYVTE
GMRKPAFLSGEQKKAIVDLLFKTNRKVTVKQLKEDYFKKIECFDSVEISGVEDRFNASLGTYHDLLKIIKDKDFLD
NEENEDILEDIVLTLTLFEDREMIEERLKTYAHLFDDKVMKQLKRRRYTGWGRLSRKLINGIRDKQSGKTILDFLK
SDGFANRNFMQLIHDDSLTFKEDIQKAQVSGQGDSLHEHIANLAGSPAIKKGILQTVKVVDELVKVMGRHKPENIV
IEMARENQTTQKGQKNSRERMKRIEEGIKELGSQILKEHPVENTQLQNGRDMYVDQELDINRLSDY
DVDHIVPQSFLKDDSIDNKVLTRSDKNRGKSDNVPSEEVVKKMKNYWRQLLNAKLITQRKFDNLTKAERGGLSELD
KAGFIKRQLVETRQITKHVAQILDSRMNTKYDENDKLIREVKVITLKSKLVSDFRKDFQFYKVREINNYHHAHDAY
LNAVVGTALIKKYPKLESEFVYGDYKVYDVRKMIAKSEQEIGKATAKYFFYSNIMNFFKTEITLANGEIRKRPLIE
TNGETGEIVWDKGRDFATVRKVLSMPQVNIVKKTEVQTGGFSKESILPKRNSDKLIARKKDWDPKKYGGFDSPTVA
YSVLVVAKVEKGKSKKLKSVKELLGITIMERSSFEKNPIDFLEAKGYKEVKKDLIIKLPKYSLFELENGRKRMLAS
AGELQKGNELALPSKYVNFLYLASHYEKLKGSPEDNEQKQLFVEQHKHYLDEIIEQISEFSKRVILADANLDKVLS
AYNKHRDKPIREQAENIIHLFTLTNLGAPAAFKYFDTTIDRKRYTSTKEVLDATLIHQSITGLYETRIDLSQLGGD
XPXPXPXPXPXPXPXP*MVSKGEEDNMAIIKEFMRFKVHMEGSVNGHEFEIEGEGEGRPYEGTQTAKLKVTKGGP*
*LPFAWDILSPQFMYGSKAYVKHPADIPDYIKLSFPEGFKWERVMNFEDGGVVTVTQDSSLQDGEFIYKVKLRGTNF*
*PSDGPVMQKKTMGWEASSERMYPEDGALKGEIKQRLKLKDGGHYDAEVKTTYKAKKPVQLPGAYNVNIKLDITSHN*
*EDYTIVEQYERAEGRHSTGGMDELYK*

SEQ ID NO: 100
MDKKYSIGLDIGTNSVGWAVITDEYKVPSKKFKVLGNTDRHSIKKNLIGALLFDSGETAEATRLKRTARRRYTRRK
NRICYLQEIFSNEMAKVDDSFFHRLEESFLVEEDKKHERHPIFGNIVDEVAYHEKYPTIYHLRKKLVDSTDKADLR
LIYLALAHMIKFRGHFLIEGDLNPDNSDVDKLFIQLVQTYNQLFEENPINASGVDAKAILSARLSKSRRLENLIAQ
LPGEKKNGLFGNLIALSLGLTPNFKSNFDLAEDAKLQLSKDTYDDDLDNLLAQIGDQYADLFLAAKNLSDAILLSD
ILRVNTEITKAPLSASMIKRYDEHHQDLTLLKALVRQQLPEKYKEIFFDQSKNGYAGYIDGGASQEEFYKFIKPIL
EKMDGTEELLVKLNREDLLRKQRTFDNGSIPHQIHLGELHAILRRQEDFYPFLKDNREKIEKILTFRIPYYVGPLA
RGNSRFAWMTRKSEETITPWNFEEVVDKGASAQSFIERMTNFDKNLPNEKVLPKHSLLYEYFTVYNELTKVKYVTE
GMRKPAFLSGEQKKAIVDLLFKTNRKVTVKQLKEDYFKKIECFDSVEISGVEDRFNASLGTYHDLLKIIKDKDFLD
NEENEDILEDIVLTLTLFEDREMIEERLKTYAHLFDDKVMKQLKRRRYTGWGRLSRKLINGIRDKQSGKTILDFLK
SDGFANRNFMQLIHDDSLTFKEDIQKAQVSGQGDSLHEHIANLAGSPAIKKGILQTVKVVDELVKVMGRHKPENIV
IEMARENQTTQKGQKNSRERMKRIEEGIKELGSQILKEHPVENTQLQNEKLYLYYLQNGRDMYVDQELDINRLSDY
DVDHIVPQSFLKDDSIDNKVLTRSDKNRGKSDNVPSEEVVKKMKNYWRQLLNAKLITQRKFDNLTKAERGGLSELD
KAGFIKRQLVETRQITKHVAQILDSRMNTKYDENDKLIREVKVITLKSKLVSDFRKDFQFYKVREINNYHHAHDAY
LNAVVGTALIKKYPKLESEFVYGDYKVYDVRKMIAKSEQEIGKATAKYFFYSNIMNFFKTEITLANGEIRKRPLIE
TNGETGEIVWDKGRDFATVRKVLSMPQVNIVKKTEVQTGGFSKESILPKRNSDKLIARKKDWDPKKYGGFDSPTVA
YSVLVVAKVEKGKSKKLKSVKELLGITIMERSSFEKNPIDFLEAKGYKEVKKDLIIKLPKYSLFELENGRKRMLAS
AGELQKGNELALPSKYVNFLYLASHYEKLKGSPEDNEQKQLFVEQHKHYLDEIIEQISEFSKRVILADANLDKVLS
AYNKHRDKPIREQAENIIHLFTLTNLGAPAAFKYFDTTIDRKRYTSTKEVLDATLIHQSITGLYETRIDLSQLGGD
XPXPXPXPXPXPXPXP*MVSKGEEDNMAIIKEFMRFKVHMEGSVNGHEFEIEGEGEGRPYEGTQTAKLKVTKG*
*GPLPFAWDILSPQFMYGSKAYVKHPADIPDYLKLSFPEGFKWERVMNFEDGGVVTVTQDSSLQDGEFIYKVKLRGT*
*NFPSDGPVMQKKTMGWEASSERMYPEDGALKGEIKQRLKLKDGGHYDAEVKTTYKAKKPVQLPGAYNVNIKLDITS*
*HNEDYTIVEQYERAEGRHSTGGMDELYK*

SEQ ID NO: 101
MDKKYSIGLDIGTNSVGWAVITDEYKVPSKKFKVLGNTDRHSIKKNLIGALLFDSGETAEATRLKRTARRRYTRRK
NRICYLQEIFSNEMAKVDDSFFHRLEESFLVEEDKKHERHPIFGNIVDEVAYHEKYPTIYHLRKKLVDSTDKADLR
LIYLALAHMIKFRGHFLIEGDLNPDNSDVDKLFIQLVQTYNQLFEENPINASGVDAKAILSARLSKSRRLENLIAQ
LPGEKKNGLFGNLIALSLGLTPNFKSNFDLAEDAKLQLSKDTYDDDLDNLLAQIGDQYADLFLAAKNLSDAILLSD
ILRVNTEITKAPLSASMIKRYDEHHQDLTLLKALVRQQLPEKYKEIFFDQSKNGYAGYIDGGASQEEFYKFIKPIL
EKMDGTEELLVKLNREDLLRKQRTFDNGSIPHQIHLGELHAILRRQEDFYPFLKDNREKIEKILTFRIPYYVGPLA
RGNSRFAWMTRKSEETITPWNFEEVVDKGASAQSFIERMTNFDKNLPNEKVLPKHSLLYEYFTVYNELTKVKYVTE
GMRKPAFLSGEQKKAIVDLLFKTNRKVTVKQLKEDYFKKIECFDSVEISGVEDRFNASLGTYHDLLKIIKDKDFLD
NEENEDILEDIVLTLTLFEDREMIEERLKTYAHLFDDKVMKQLKRRRYTGWGRLSRKLINGIRDKQSGKTILDFLK
SDGFANRNFMQLIHDDSLTFKEDIQKAQVSGQGDSLHEHIANLAGSPAIKKGILQTVKVVDELVKVMGRHKPENIV
IEMARENQTTQKGQKNSRERMKRIEEGIKELGSQILKEHPVENTQLQNEKLYLYYLQNGRDMYVDQELDINRLSDY
DVDHIVPQSFLKDDSIDNKVLTRSDKNRGKSDNVPSEEVVKKMKNYWRQLLNAKLITQRKFDNLTKAERGGLSELD
KAGFIKRQLVETRQITKHVAQILDSRMNTKYDENDKLIREVKVITLKSKLVSDFRKDFQFYKVREINNYHHAHDAY
LNAVVGTALIKKYPKLESEFVYGDYKVYDVRKMIAKSEQEIGKATAKYFFYSNIMNFFKTEITLANGEIRKRPLIE
TNGETGEIVWDKGRDFATVRKVLSMPQVNIVKKTEVQTGGFSKESILPKRNSDKLIARKKDWDPKKYGGFDSPTVA
YSVLVVAKVEKGKSKKLKSVKELLGITIMERSSFEKNPIDFLEAKGYKEVKKDLIIKLPKYSLFELENGRKRMLAS
AGELQKGNELALPSKYVNFLYLASHYEKLKGSPEDNEQKQLFVEQHKHYLDEIIEQISEFSKRVILADANLDKVLS
AYNKHRDKPIREQAENIIHLFTLINLGAPAAFKYFDTTIDRKRYTSTKEVLDATLIHQSITGLYETRIDLSQLGGD
XPXPXPXPXPXPXPXPXP*MVSKGEEDNMAIIKEFMRFKVHMEGSVNGHEFEIEGEGEGRPYEGTQTAKLKVT*
*KGGPLPFAWDILSPQFMYGSKAYVKHPADIPDYLKLSFPEGFKWERVMNFEDGGVVTVTQDSSLQDGEFIYKVKLR*
*GTNFPSDGPVMQKKTMGWEASSERMYPEDGALKGEIKQRLKLKDGGHYDAEVKTTYKAKKPVQLPGAYNVNIKLDI*
*TSHNEDYTIVEQYERAEGRHSTGGMDELYK*

SEQ ID NO: 102
MDKKYSIGLDIGTNSVGWAVITDEYKVPSKKFKVLGNTDRHSIKKNLIGALLFDSGETAEATRLKRTARRRYTRRK
NRICYLQEIFSNEMAKVDDSFFHRLEESFLVEEDKKHERHPIFGNIVDEVAYHEKYPTIYHLRKKLVDSTDKADLR

TABLE V.2-continued

Cas9-Linker-mCherryChimeras

```
LIYLALAHMIKFRGHFLIEGDLNPDNSDVDKLFIQLVQTYNQLFEENPINASGVDAKAILSARLSKSRRLENLIAQ
LPGEKKNGLFGNLIALSLGLTPNFKSNFDLAEDAKLQLSKDTYDDDLDNLLAQIGDQYADLFLAAKNLSDAILLSD
ILRVNTEITKAPLSASMIKRYDEHHQDLTLLKALVRQQLPEKYKEIFFDQSKNGYAGYIDGGASQEEFYKFIKPIL
EKMDGTEELLVKLNREDLLRKQRTFDNGSIPHQIHLGELHAILRRQEDFYPFLKDNREKIEKILTFRIPYYVGPLA
RGNSRFAWMTRKSEETITPWNFEEVVDKGASAQSFIERMTNFDKNLPNEKVLPKHSLLYEYFTVYNELTKVKYTE
GMRKPAFLSGEQKKAIVDLLFKTNRKVTVKQLKEDYFKKIECFDSVEISGVEDRFNASLGTYHDLLKIIKDKDFLD
NEENEDILEDIVLTLTLFEDREMIEERLKTYAHLFDDKVMKQLKRRRYTGWGRLSRKLINGIRDKQSGKTILDFLK
SDGFANRNFMQLIHDDSLTFKEDIQKAQVSGQGDSLHEHIANLAGSPAIKKGILQTVKVVDELVKVMGRHKPENIV
IEMARENQTTQKGQKNSRERMKRIEEGIKELGSQILKEHPVENTQLQNEKLYLYYLQNGRDMYVDQELDINRLSDY
DVDHIVPQSFLKDDSIDNKVLTRSDKNRGKSDNVPSEEVVKKMKNYWRQLLNAKLITQRKFDNLTKAERGGLSELD
KAGFIKRQLVETRQITKHVAQILDSRMNTKYDENDKLIREVKVITLKSKLVSDFRKDFQFYKVREINNYHHAHDAY
LNAVVGTALIKKYPKLESEFVYGDYKVYDVRKMIAKSEQEIGKATAKYFFYSNIMNFFKTEITLANGEIRKRPLIE
TNGETGEIVWDKGRDFATVRKVLSMPQVNIVKKTEVQTGGFSKESILPKRNSDKLIARKKDWDPKKYGGFDSPTVA
YSVLVVAKVEKGKSKKLKSVKELLGITIMERSSFEKNPIDFLEAKGYKEVKKDLIIKLPKYSLFELENGRKRMLAS
AGELQKGNELALPSKYVNFLYLASHYEKLKGSPEDNEQKQLFVEQHKYLDEIIEQISEFSKRVILADANLDKVLS
AYNKHRDKPIREQAENIIHLFTLTNLGAPAAFKYFDTTIDRKRYTSTKEVLDATLIHQSITGLYETRIDLSQLGGD
XPXPXPXPXPXPXPXPXPXPXP**MVSKGEEDNMAIIKEFMRFKVHMEGSVNGHEFEIEGEGEGRPYEGTQTAKLK
VTKGGPLPFAWDILSPQFMYGSKA**YVKHPADIPDYLKLSFPEGFKWERVMNFEDGGVVTVTQDSSLQDGEFIYKVK
LRGTNFPSDGPVMQKKTMGWEASSERYPEDGALKGEIKQRLKLKDGGHYDAEVKTTYKAKKPVQLPGAYNVNIKL
DITSHNEDYTIVEQYERAEGRHSTGGMDELYK

SEQ ID NO: 103
MDKKYSIGLDIGTNSVGWAVITDEYKVPSKKFKVLGNTDRHSIKKNLIGALLFDSGETAEATRLKRTARRRYTRRK
NRICYLQEIFSNEMAKVDDSFFHRLEESFLVEEDKKHERHPIFGNIVDEVAYHEKYPTIYHLRKKLVDSTDKADLR
LIYLALAHMIKFRGHFLIEGDLNPDNSDVDKLFIQLVQTYNQLFEENPINASGVDAKAILSARLSKSRRLENLIAQ
LPGEKKNGLFGNLIALSLGLTPNFKSNFDLAEDAKLQLSKDTYDDDLDNLLAQIGDQYADLFLAAKNLSDAILLSD
ILRVNTEITKAPLSASMIKRYDEHHQDLTLLKALVRQQLPEKYKEIFFDQSKNGYAGYIDGGASQEEFYKFIKPIL
EKMDGTEELLVKLNREDLLRKQRTFDNGSIPHQIHLGELHAILRRQEDFYPFLKDNREKIEKILTFRIPYYVGPLA
RGNSRFAWMTRKSEETITPWNFEEVVDKGASAQSFIERMTNFDKNLPNEKVLPKHSLLYEYFTVYNELTKVKYTE
GMRKPAFLSGEQKKAIVDLLFKTNRKVTVKQLKEDYFKKIECFDSVEISGVEDRFNASLGTYHDLLKIIKDKDFLD
NEENEDILEDIVLTLTLFEDREMIEERLKTYAHLFDDKVMKQLKRRRYTGWGRLSRKLINGIRDKQSGKTILDFLK
SDGFANRNFMQLIHDDSLTFKEDIQKAQVSGQGDSLHEHIANLAGSPAIKKGILQTVKVVDELVKVMGRHKPENIV
IEMARENQTTQKGQKNSRERMKRIEEGIKELGSQILKEHPVENTQLQNEKLYLYYLQNGRDMYVDQELDINRLSDY
DVDHIVPQSFLKDDSIDNKVLTRSDKNRGKSDNVPSEEVVKKMKNYWRQLLNAKLITQRKFDNLTKAERGGLSELD
KAGFIKRQLVETRQITKHVAQILDSRMNTKYDENDKLIREVKVITLKSKLVSDFRKDFQFYKVREINNYHHAHDAY
LNAVVGTALIKKYPKLESEFVYGDYKVYDVRKMIAKSEQEIGKATAKYFFYSNIMNFFKTEITLANGEIRKRPLIE
TNGETGEIVWDKGRDFATVRKVLSMPQVNIVKKTEVQTGGFSKESILPKRNSDKLIARKKDWDPKKYGGFDSPTVA
YSVLVVAKVEKGKSKKLKSVKELLGITIMERSSFEKNPIDFLEAKGYKEVKKDLIIKLPKYSLFELENGRKRMLAS
AGELQKGNELALPSKYVNFLYLASHYEKLKGSPEDNEQKQLFVEQHKYLDEIIEQISEFSKRVILADANLDKVLS
AYNKHRDKPIREQAENIIHLFTLTNLGAPAAFKYFDTTIDRKRYTSTKEVLDATLIHQSITGLYETRIDLSQLGGD
XPXPXPXPXPXPXPXPXPXPXP**MVSKGEEDNMAIIKEFMRFKVHMEGSVN
HPADIPDYLKLSFPEGFKWERVMNFEDGGVVTVTQDSSLQDGEFIYK
GHEFEIEGEGEGRPYEGTQTAKLKVTKGGPLPFAWDILSPQFMYGSKAYV
VKLRGTNFPSDGPVMQKKTMGWEASSERMYP
EDGALKGEIKQRLKLKDGGHYDAEVKTTYKAKKPVQLPGAYNVNI
KLDITSHNEDYTIVEQYERAEGRHSTGGMDELYK**

SEQ ID NO: 104
MDKKYSIGLDIGTNSVGWAVITDEYKVPSKKFKVLGNTDRHSIKKNLIGALLFDSGETAEATRLKRTARRRYTRRK
NRICYLQEIFSNEMAKVDDSFFHRLEESFLVEEDKKHERHPIFGNIVDEVAYHEKYPTIYHLRKKLVDSTDKADLR
LIYLALAHMIKFRGHFLIEGDLNPDNSDVDKLFIQLVQTYNQLFEENPINASGVDAKAILSARLSKSRRLENLIAQ
LPGEKKNGLFGNLIALSLGLTPNFKSNFDLAEDAKLQLSKDTYDDDLDNLLAQIGDQYADLFLAAKNLSDAILLSD
ILRVNTEITKAPLSASMIKRYDEHHQDLTLLKALVRQQLPEKYKEIFFDQSKNGYAGYIDGGASQEEFYKFIKPIL
EKMDGTEELLVKLNREDLLRKQRTFDNGSIPHQIHLGELHAILRRQEDFYPFLKDNREKIEKILTFRIPYYVGPLA
RGNSRFAWMTRKSEETITPWNFEEVVDKGASAQSFIERMTNFDKNLPNEKVLPKHSLLYEYFTVYNELTKVKYTE
GMRKPAFLSGEQKKAIVDLLFKTNRKVTVKQLKEDYFKKIECFDSVEISGVEDRFNASLGTYHDLLKIIKDKDFLD
NEENEDILEDIVLTLTLFEDREMIEERLKTYAHLFDDKVMKQLKRRRYTGWGRLSRKLINGIRDKQSGKTILDFLK
SDGFANRNFMQLIHDDSLTFKEDIQKAQVSGQGDSLHEHIANLAGSPAIKKGILQTVKVVDELVKVMGRHKPENIV
IEMARENQTTQKGQKNSRERMKRIEEGIKELGSQILKEHPVENTQLQNEKLYLYYLQNGRDMYVDQELDINRLSDY
DVDHIVPQSFLKDDSIDNKVLTRSDKNRGKSDNVPSEEVVKKMKNYWRQLLNAKLITQRKFDNLTKAERGGLSELD
KAGFIKRQLVETRQITKHVAQILDSRMNTKYDENDKLIREVKVITLKSKLVSDFRKDFQFYKVREINNYHHAHDAY
LNAVVGTALIKKYPKLESEFVYGDYKVYDVRKMIAKSEQEIGKATAKYFFYSNIMNFFKTEITLANGEIRKRPLIE
TNGETGEIVWDKGRDFATVRKVLSMPQVNIVKKTEVQTGGFSKESILPKRNSDKLIARKKDWDPKKYGGFDSPTVA
YSVLVVAKVEKGKSKKLKSVKELLGITIMERSSFEKNPIDFLEAKGYKEVKKDLIIKLPKYSLFELENGRKRMLAS
AGELQKGNELALPSKYVNFLYLASHYEKLKGSPEDNEQKQLFVEQHKYLDEIIEQISEFSKRVILADANLDKVLS
AYNKHRDKPIREQAENIIHLFTLTNLGAPAAFKYFDTTIDRKRYTSTKEVLDATLIHQSITGLYETRIDLSQLGGD
XPXPXPXPXPXPXPXPXPXPXP**MVSKGEEDNMAIIKEFMRFKVHMEGSV
NGHEFEIEGEGEGRPYEGTQTAKLKVTKGGPLPFAWDILSPQFMYGSKAY
VKHPADIPDYLKLSFPEGFKWERVMNFEDGGVVTVTQDSSLQDGEFI
YKVKLRGTNFPSDGPVMQKKTMGWEASSERMYPEDGALKGEIKQRLKLKDGGHYDA
EVKTTYKAKKPVQLPGAYNVNIKLDITSHNEDYTIVEQ
YERAEGRHSTGGMDELYK**

SEQ ID NO: 105
MDKKYSIGLDIGTNSVGWAVITDEYKVPSKKFKVLGNTDRHSIKKNLIGALLFDSGETAEATRLKRTARRRYTRRK
NRICYLQEIFSNEMAKVDDSFFHRLEESFLVEEDKKHERHPIFGNIVDEVAYHEKYPTIYHLRKKLVDSTDKADLR
LIYLALAHMIKFRGHFLIEGDLNPDNSDVDKLFIQLVQTYNQLFEENPINASGVDAKAILSARLSKSRRLENLIAQ
LPGEKKNGLFGNLIALSLGLTPNFKSNFDLAEDAKLQLSKDTYDDDLDNLLAQIGDQYADLFLAAKNLSDAILLSD
```

TABLE V.2-continued

Cas9-Linker-mCherryChimeras

```
ILRVNTEITKAPLSASMIKRYDEHHQDLTLLKALVRQQLPEKYKEIFFDQSKNGYAGYIDGGASQEEFYKFIKPIL
EKMDGTEELLVKLNREDLLRKQRTFDNGSIPHQIHLGELHAILRRQEDFYPFLKDNREKIEKILTFRIPYYVGPLA
RGNSRFAWMTRKSEETITPWNFEEVVDKGASAQSFIERMTNFDKNLPNEKVLPKHSLLYEYFTVYNELTKVKYVTE
GMRKPAFLSGEQKKAIVDLLFKTNRKVTVKQLKEDYFKKIECFDSVEISGVEDRFNASLGTYHDLLKIIKDKDFLD
NEENEDILEDIVLTLTLFEDREMIEERLKTYAHLFDDKVMKQLKRRRYTGWGRLSRKLINGIRDKQSGKTILDFLK
SDGFANRNFMQLIHDDSLTFKEDIQKAQVSGQGDSLHEHIANLAGSPAIKKGILQTVKVVDELVKVMGRHKPENIV
IEMARENQTTQKGQKNSRERMKRIEEGIKELGSQILKEHPVENTQLQNEKLYLYYLQNGRDMYVDQELDINRLSDY
DVDHIVPQSFLKDDSIDNKVLTRSDKNRGKSDNVPSEEVVKKMKNYWRQLLNAKLITQRKFDNLTKAERGGLSELD
KAGFIKRQLVETRQITKHVAQILDSRMNTKYDENDKLIREVKVITLKSKLVSDFRKDFQFYKVREINNYHHAHDAY
LNAVVGTALIKKYPKLESEFVYGDYKVYDVRKMIAKSEQEIGKATAKYFFYSNIMNFFKTEITLANGEIRKRPLIE
TNGETGEIVWDKGRDFATVRKVLSMPQVNIVKKTEVQTGGFSKESILPKRNSDKLIARKKDWDPKKYGGFDSPTVA
YSVLVVAKVEKGKSKKLKSVKELLGITIMERSSFEKNPIDFLEAKGYKEVKKDLIIKLPKYSLFELENGRKRMLAS
AGELQKGNELALPSKYVNFLYLASHYEKLKGSPEDNEQKQLFVEQHKHYLDEIIEQISEFSKRVILADANLDKVLS
AYNKHRDKPIREQAENIIHLFTLINLGAPAAFKYFDTTIDRKRYTSTKEVLDATLIHQSITGLYETRIDLSQLGGD
GGGGSEAAAKGGGGSMVSKGEEDNMAIIKEFMRFKVHMEGSVNGHEFEIEGEGEGRPYE
GTQTAKLKVTKGGPLPFAWDILSPQFMYGSKAYVKHPADIPD
YLKLSFPEGFKWERVMNFEDGGVVTVTQDSSLQDGEFIYKVKLRGTNFPSD
GPVMQKKTMGWEASSERMYPEDGALKGEIKQRLKLKDGGHYDAEVKTTYKAK
KPVQLPGAYNVNIKLDITSHNEDYTIVEQYERAEGRHSTGGMDELYK
```

Table V.3 provides chimera fusion proteins between AsCas12a amino acid sequences, linker amino acid sequences (underlined), and eGFP amino acid sequences (bolded, italicized).

TABLE V.3

AsCas12a-Linker-eGFP Chimeras

```
SEQ ID NO: 106
MTQFEGFTNLYQVSKTLRFELIPQGKTLKHIQEQGFIEEDKARNDHYKELKPIIDRIYKTYADQCLQLVQLDWENLS
AAIDSYRKEKTEETRNALIEEQATYRNAIHDYFIGRTDNLTDAINKRHAEIYKGLFKAELFNGKVLKQLGTVTTTEH
ENALLRSFDKFTTYFSGFYENRKNVFSAEDISTAIPHRIVQDNFPKFKENCHIFTRLITAVPSLREHFENVKKAIGI
FVSTSIEEVFSPPFYNQLLTQTQIDLYNQLLGGISREAGTEKIKGLNEVLNLAIQKNDETAHIIASLPHRFIPLFKQ
ILSDRNTLSFILEEFKSDEEVIQSFCKYKTLLRNENVLETAEALFNELNSIDLTHIFISHKKLETISSALCDHWDTL
RNALYERRISELTGKITKSAKEKVQRSLKHEDINLQEIISAAGKELSEAFKQKTSEILSHAHAALDQPLPTTLKKQE
EKEILKSQLDSLLGLYHLLDWFAVDESNEVDPEFSARLTGIKLEMEPSLSFYNKARNYATKKPYSVEKFKLNFQMPT
LASGWDVNKEKNNGAILFVKNGLYYLGIMPKQKGRYKALSFEPTEKTSEGFDKMYYDYFPDAAKMIPKCSTQLKAVT
AHFQTHTTPILLSNNFIEPLEITKEIYDLNNPEKEPKKFQTAYAKKTGDQKGYREALCKWIDFTRDFLSKYTKTTSI
DLSSLRPSSQYKDLGEYYAELNPLLYHISFQRIAEKEIMDAVETGKLYLFQIYNKDFAKGHHGKPNLHTLYWTGLFS
PENLAKTSIKLNGQAELFYRPKSRMKRMAHRLGEKMLNKKLKDQKTPIPDTLYQELYDYVNHRLSHDLSDEARALLP
NVITKEVSHEIIKDRRFTSDKFFFHVPITLNYQAANSPSKFNQRVNAYLKEHPETPIIGIDRGERNLIYITVIDSTG
KILEQRSLNTIQQFDYQKKLDNREKERVAARQAWSVVGTIKDLKQGYLSQVIHEIVDLMIHYQAVVVLENLNFGFKS
KRTGIAEKAVYQQFEKMLIDKLNCLVLKDYPAEKVGGVLNPYQLTDQFTSFAKMGTQSGFLFYVPAPYTSKIDPLTG
FVDPFVWKTIKNHESRKHFLEGFDFLHYDVKTGDFILHFKMNRNLSFQRGLPGFMPAWDIVFEKNETQFDAKGTPFI
AGKRIVPVIENHRFTGRYRDLYPANELIALLEEKGIVFRDGSNILPKLLENDDSHAIDTMVALIRSVLQMRNSNAAT
GEDYINSPVRDLNGVCFDSRFQNPEWPMDADANGAYHIALKGQLLLNHLKESKDLKLQNGISNQDWLAYIQELRN
GSAGSAAGSGEFMVSKGEELFTGVVPILVELDGDVNGHKFSVSGEGEGDATYGKLTLKF
ICTTGKLPVPWPTLVTTLTYGVQCFSRYPDHMKQHDFFKSAMPEGY
VQERTIFFKDDGNYKTRAEVKFEGDTLVNRIELKGIDFKEDGNILGH
KLEYNYNSHNVYIMADKQKNGIKVNFKIRHNIEDGSVQLADHYQQNTPIGDGPVL
LPDNHYLSTQSALSKDPNEKRDHMVLLEFVTAAGITLGMDELYK

SEQ ID NO: 107
MTQFEGFTNLYQVSKTLRFELIPQGKTLKHIQEQGFIEEDKARNDHYKELKPIIDRIYKTYADQCLQLVQLDWENLS
AAIDSYRKEKTEETRNALIEEQATYRNAIHDYFIGRTDNLTDAINKRHAEIYKGLFKAELFNGKVLKQLGTVTTTEH
ENALLRSFDKFTTYFSGFYENRKNVFSAEDISTAIPHRIVQDNFPKFKENCHIFTRLITAVPSLREHFENVKKAIGI
FVSTSIEEVFSPPFYNQLLTQTQIDLYNQLLGGISREAGTEKIKGLNEVLNLAIQKNDETAHIIASLPHRFIPLFKQ
ILSDRNTLSFILEEFKSDEEVIQSFCKYKTLLRNENVLETAEALFNELNSIDLTHIFISHKKLETISSALCDHWDTL
RNALYERRISELTGKITKSAKEKVQRSLKHEDINLQEIISAAGKELSEAFKQKTSEILSHAHAALDQPLPTTLKKQE
EKEILKSQLDSLLGLYHLLDWFAVDESNEVDPEFSARLTGIKLEMEPSLSFYNKARNYATKKPYSVEKFKLNFQMPT
LASGWDVNKEKNNGAILFVKNGLYYLGIMPKQKGRYKALSFEPTEKTSEGFDKMYYDYFPDAAKMIPKCSTQLKAVT
AHFQTHTTPILLSNNFIEPLEITKEIYDLNNPEKEPKKFQTAYAKKTGDQKGYREALCKWIDFTRDFLSKYTKTTSI
DLSSLRPSSQYKDLGEYYAELNPLLYHISFQRIAEKEIMDAVETGKLYLFQIYNKDFAKGHHGKPNLHTLYWTGLFS
PENLAKTSIKLNGQAELFYRPKSRMKRMAHRLGEKMLNKKLKDQKTPIPDTLYQELYDYVNHRLSHDLSDEARALLP
NVITKEVSHEIIKDRRFTSDKFFFHVPITLNYQAANSPSKFNQRVNAYLKEHPETPIIGIDRGERNLIYITVIDSTG
KILEQRSLNTIQQFDYQKKLDNREKERVAARQAWSVVGTIKDLKQGYLSQVIHEIVDLMIHYQAVVVLENLNFGFKS
KRTGIAEKAVYQQFEKMLIDKLNCLVLKDYPAEKVGGVLNPYQLTDQFTSFAKMGTQSGFLFYVPAPYTSKIDPLTG
FVDPFVWKTIKNHESRKHFLEGFDFLHYDVKTGDFILHFKMNRNLSFQRGLPGFMPAWDIVFEKNETQFDAKGTPFI
AGKRIVPVIENHRFTGRYRDLYPANELIALLEEKGIVFRDGSNILPKLLENDDSHAIDTMVALIRSVLQMRNSNAAT
GEDYINSPVRDLNGVCFDSRFQNPEWPMDADANGAYHIALKGQLLLNHLKESKDLKLQNGISNQDWLAYIQELRN
GGGGSGGGGSGGGGSGGGGSMVSKGEELFTGVVPILVELDGDVNGHKFSVSGEGEGDAT
YGKLTLKFICTTGKLPVPWPTLVTTLTYGVQCFSRYPDHMKQ
```

TABLE V.3-continued

AsCas12a-Linker-eGFP Chimeras

*HDFFKSAMPEGYVQERTIFFKDDGNYKTRAEVKFEGDTLVNRIELKGIDFK*
*EDGNILGHKLEYNYNSHNVYIMADKQKNGIIKVNFKIRHNIEDSVQLADHYQQNTPIG*
*DGPVLLPDNHYLSTQSALSKDPNEKRDHMVLLEFVTAAGITLGMDELYK*

SEQ ID NO: 108
MTQFEGFTNLYQVSKTLRFELIPQGKTLKHIQEQGFIEEDKARNDHYKELKPIIDRIYKTYADQCLQLVQLDWENLS
AAIDSYRKEKTEETRNALIEEQATYRNAIHDYFIGRTDNLTDAINKRHAEIYKGLFKAELFNGKVLKQLGTVTTTEH
ENALLRSFDKFTTYFSGFYENRKNVFSAEDISTAIPHRIVQDNFPKFKENCHIFTRLITAVPSLREHFENVKKAIGI
FVSTSIEEVFSFPPFYNQLLTQTQIDLYNQLLGGISREAGTEKIKGLNEVLNLAIQKNDETAHIIASLPHRFIPLFKQ
ILSDRNTLSFILEEFKSDEEVIQSFCKYKTLLRNENVLETAEALFNELNSIDLTHIFISHKKLETISSALCDHWDTL
RNALYERRISELTGKITKSAKEKVQRSLKHEDINLQEIISAAGKELSEAFKQKTSEILSHAHAALDQPLPTTLKKQE
EKEILKSQLDSLLGLYHLLDWFAVDESNEVDPEFSARLTGIKLEMEPSLSFYNKARNYATKKPYSVEKFKLNFQMPT
LASGWDVNKEKNNGAILFVKNGLYYLGIMPKQKGRYKALSFEPTEKTSEGFDKMYYDYFPDAAKMIPKCSTQLKAVT
AHFQTHTTPILLSNNFIEPLEITKEIYDLNNPEKEPKKFQTAYAKKTGDQKGYREALCKWIDFTRDFLSKYTKTTSI
DLSSLRPSSQYKDLGEYYAELNPLLYHISFQRIAEKEIMDAVETGKLYLFQIYNKDFAKGHHGKPNLHTLYWTGLFS
PENLAKTSIKLNGQAELFYRPKSRMKRMAHRLGEKMLNKKLKDQKTPIPDTLYQELYDYVNHRLSHDLSDEARALLP
NVITKEVSHEIIKDRRFTSDKFFFHVPITLNYQAANSPSKFNQRVNAYLKEHPETPIIGIDRGERNLIYITVIDSTG
KILEQRSLNTIQQFDYQKKLDNREKERVAARQAWSVVGTIKDLKQGYLSQVIHEIVDLMIHYQAVVVLENLNFGFKS
KRTGIAEKAVYQQFEKMLIDKLNCLVLKDYPAEKVGGVLNPYQLTDQFTSFAKMGTQSGFLFYVPAPYTSKIDPLTG
FVDPFVWKTIKNHESRKHFLEGFDFLHYDVKTGDFILHFKMNRNLSFQRGLPGFMPAWDIVFEKNETQFDAKGTPFI
AGKRIVPVIENHRFTGYRDLYPANELIALLEEKGIVFRDGSNILPKLLENDDSHAIDTMVALIRSVLQMRNSNAAT
GEDYINSPVRDLNGVCFDSRFQNPEWPMDADANGAYHIALKGQLLLNHLKESKDLKLQNGISNQDWLAYIQELRN
AEAAAKEAAAKEAAAKEAAAK*MVSKGEELFTGVVPILVELDGDVNGHKF*
*SVSGEGEGDATYGKLTLKFICTTGKIPVPWPTLVTTLTYGVQCFSRYPDHMKQHDF*
*FKSAMPEGYVQERTIFFKDDGNYKTRAEVKFEGDTLVNRIELKGID*
*FKEDGNILGHKLEYNYNSHNVYIMADKQKNGIKVNFKIRHNIEDSVQLADHYQQN*
*TPIGDGPVLLPDNHYLSTQSALSKDPNEKRDHMVLLEFVTAAGITLGMDELYK*

SEQ ID NO: 109
MTQFEGFTNLYQVSKTLRFELIPQGKTLKHIQEQGFIEEDKARNDHYKELKPIIDRIYKTYADQCLQLVQLDWENLS
AAIDSYRKEKTEETRNALIEEQATYRNAIHDYFIGRTDNLTDAINKRHAEIYKGLFKAELFNGKVLKQLGTVTTTEH
ENALLRSFDKFTTYFSGFYENRKNVFSAEDISTAIPHRIVQDNFPKFKENCHIFTRLITAVPSLREHFENVKKAIGI
FVSTSIEEVFSFPPFYNQLLTQTQIDLYNQLLGGISREAGTEKIKGLNEVLNLAIQKNDETAHIIASLPHRFIPLFKQ
ILSDRNTLSFILEEFKSDEEVIQSFCKYKTLLRNENVLETAEALFNELNSIDLTHIFISHKKLETISSALCDHWDTL
RNALYERRISELTGKITKSAKEKVQRSLKHEDINLQEIISAAGKELSEAFKQKTSEILSHAHAALDQPLPTTLKKQE
EKEILKSQLDSLLGLYHLLDWFAVDESNEVDPEFSARLTGIKLEMEPSLSFYNKARNYATKKPYSVEKFKLNFQMPT
LASGWDVNKEKNNGAILFVKNGLYYLGIMPKQKGRYKALSFEPTEKTSEGFDKMYYDYFPDAAKMIPKCSTQLKAVT
AHFQTHTTPILLSNNFIEPLEITKEIYDLNNPEKEPKKFQTAYAKKTGDQKGYREALCKWIDFTRDFLSKYTKTTSI
DLSSLRPSSQYKDLGEYYAELNPLLYHISFQRIAEKEIMDAVETGKLYLFQIYNKDFAKGHHGKPNLHTLYWTGLFS
PENLAKTSIKLNGQAELFYRPKSRMKRMAHRLGEKMLNKKLKDQKTPIPDTLYQELYDYVNHRLSHDLSDEARALLP
NVITKEVSHEIIKDRRFTSDKFFFHVPITLNYQAANSPSKFNQRVNAYLKEHPETPIIGIDRGERNLIYITVIDSTG
KILEQRSLNTIQQFDYQKKLDNREKERVAARQAWSVVGTIKDLKQGYLSQVIHEIVDLMIHYQAVVVLENLNFGFKS
KRTGIAEKAVYQQFEKMLIDKLNCLVLKDYPAEKVGGVLNPYQLTDQFTSFAKMGTQSGFLFYVPAPYTSKIDPLTG
FVDPFVWKTIKNHESRKHFLEGFDFLHYDVKTGDFILHFKMNRNLSFQRGLPGFMPAWDIVFEKNETQFDAKGTPFI
AGKRIVPVIENHRFTGYRDLYPANELIALLEEKGIVFRDGSNILPKLLENDDSHAIDTMVALIRSVLQMRNSNAAT
GEDYINSPVRDLNGVCFDSRFQNPEWPMDADANGAYHIALKGQLLLNHLKESKDLKLQNGISNQDWLAYIQELRN
AEAAAKEAAAKEAAAKEAAAKALEAEAAAKEAAAKEAAAKEAAAKA
*MVSKGEELFTGVVPILVELDGDVNGHKFSVSGEGEGDATYGKLTLKFICTTGKLPV*
*PWPTLVTTLTYGVQCFSRYPDHMKQHDFFKSAMPEGYVQERTIFFKDDGN*
*YKTRAEVKFEGDTLVNRIELKGIDFKE DGNILGHKLEYNYNSHNVYIMADKQKNG*
*IKVNFKIRHNIEDSVQLADHYQQNTPIGDGPVLLPDNHYLSTQSALSKDPNEKRDHMVLLEFVTAAGITLGMDELYK*

SEQ ID NO: 110
MTQFEGFTNLYQVSKTLRFELIPQGKTLKHIQEQGFIEEDKARNDHYKELKPIIDRIYKTYADQCLQLVQLDWENLS
AAIDSYRKEKTEETRNALIEEQATYRNAIHDYFIGRTDNLTDAINKRHAEIYKGLFKAELFNGKVLKQLGTVTTTEH
ENALLRSFDKFTTYFSGFYENRKNVFSAEDISTAIPHRIVQDNFPKFKENCHIFTRLITAVPSLREHFENVKKAIGI
FVSTSIEEVFSFPPFYNQLLTQTQIDLYNQLLGGISREAGTEKIKGLNEVLNLAIQKNDETAHIIASLPHRFIPLFKQ
ILSDRNTLSFILEEFKSDEEVIQSFCKYKTLLRNENVLETAEALFNELNSIDLTHIFISHKKLETISSALCDHWDTL
RNALYERRISELTGKITKSAKEKVQRSLKHEDINLQEIISAAGKELSEAFKQKTSEILSHAHAALDQPLPTTLKKQE
EKEILKSQLDSLLGLYHLLDWFAVDESNEVDPEFSARLTGIKLEMEPSLSFYNKARNYATKKPYSVEKFKLNFQMPT
LASGWDVNKEKNNGAILFVKNGLYYLGIMPKQKGRYKALSFEPTEKTSEGFDKMYYDYFPDAAKMIPKCSTQLKAVT
AHFQTHTTPILLSNNFIEPLEITKEIYDLNNPEKEPKKFQTAYAKKTGDQKGYREALCKWIDFTRDFLSKYTKTTSI
DLSSLRPSSQYKDLGEYYAELNPLLYHISFQRIAEKEIMDAVETGKLYLFQIYNKDFAKGHHGKPNLHTLYWTGLFS
PENLAKTSIKLNGQAELFYRPKSRMKRMAHRLGEKMLNKKLKDQKTPIPDTLYQELYDYVNHRLSHDLSDEARALLP
NVITKEVSHEIIKDRRFTSDKFFFHVPITLNYQAANSPSKFNQRVNAYLKEHPETPIIGIDRGERNLIYITVIDSTG
KILEQRSLNTIQQFDYQKKLDNREKERVAARQAWSVVGTIKDLKQGYLSQVIHEIVDLMIHYQAVVVLENLNFGFKS
KRTGIAEKAVYQQFEKMLIDKLNCLVLKDYPAEKVGGVLNPYQLTDQFTSFAKMGTQSGFLFYVPAPYTSKIDPLTG
FVDPFVWKTIKNHESRKHFLEGFDFLHYDVKTGDFILHFKMNRNLSFQRGLPGFMPAWDIVFEKNETQFDAKGTPFI
AGKRIVPVIENHRFTGYRDLYPANELIALLEEKGIVFRDGSNILPKLLENDDSHAIDTMVALIRSVLQMRNSNAAT
GEDYINSPVRDLNGVCFDSRFQNPEWPMDADANGAYHIALKGQLLLNHLKESKDLKLQNGISNQDWLAYIQELRN
LEAEAAAKEAAAKEAAAKEAAAKALEAEAAAKEAAAKEAAAKEAAAKALE *MVSKGEELFTGVVPILVELDGDVNGHK*
*FSVSGEGEGDATYGKLTLKFICTTGKLPVPWPTLVTTLTYGVQCFSRYPDHMKQHDFFKSAMPEGYVQERTIFFKDD*
*GNYKTRAEVKFEGDTLVNRIELKGIDFKEDGNILGHKLEYNYNSHNVYIMADKQKNGIKVNFKIRHNIEDSVQLAD*
*HYQQNTPIGDGPVLLPDNHYLSTQSALSKDPNEKRDHMVLLEFVTAAGITLGMDELYK*

SEQ ID NO: 111
MTQFEGFTNLYQVSKTLRFELIPQGKTLKHIQEQGFIEEDKARNDHYKELKPIIDRIYKTYADQCLQLVQLDWENLS
AAIDSYRKEKTEETRNALIEEQATYRNAIHDYFIGRTDNLTDAINKRHAEIYKGLFKAELFNGKVLKQLGTVTTTEH

TABLE V.3-continued

AsCas12a-Linker-eGFP Chimeras

ENALLRSFDKFTTYFSGFYENRKNVFSAEDISTAIPHRIVQDNFPKFKENCHIFTRLITAVPSLREHFENVKKAIGI
FVSTSIEEVFSPPFYNQLLTQTQIDLYNQLLGGISREAGTEKIKGLNEVLNLAIQKNDETAHIIASLPHRFIPLFKQ
ILSDRNTLSFILEEFKSDEEVIQSFCKYKTLLRNENVLETAEALFNELNSIDLTHIFISHKKLETISSALCDHWDTL
RNALYERRISELTGKITKSAKEKVQRSLKHEDINLQEIISAAGKELSEAFKQKTSEILSHAHAALDQPLPTTLKKQE
EKEILKSQLDSLLGLYHLLDWFAVDESNEVDPEFSARLTGIKLEMEPSLSFYNKARNYATKKPYSVEKFKLNFQMPT
LASGWDVNKEKNNGAILFVKNGLYYLGIMPKQKGRYKALSFEPTEKTSEGFDKMYYDYFPDAAKMIPKCSTQLKAVT
AHFQTHTTPILLSNNFIEPLEITKEIYDLNNPEKEPKKFQTAYAKKTGDQKGYREALCKWIDFTRDFLSKYTKTTSI
DLSSLRPSSQYKDLGEYYAELNPLLYHISFQRIAEKEIMDAVETGKLYLFQIYNKDFAKGHHGKPNLHTLYWTGLFS
PENLAKTSIKLNGQAELFYRPKSRMKRMAHRLGEKMLNKKLKDQKTPIPDTLYQELYDYVNHRLSHDLSDEARALLP
NVITKEVSHEIIKDRRFTSDKFFFHVPITLNYQAANSPSKFNQRVNAYLKEHPETPIIGIDRGERNLIYITVIDSTG
KILEQRSLNTIQQFDYQKKLDNREKERVAARQAWSVVGTIKDLKQGYLSQVIHEIVDLMIHYQAVVVLENLNFGFKS
KRTGIAEKAVYQQFEKMLIDKLNCLVLKDYPAEKVGGVLNPYQLTDQFTSFAKMGTQSGFLFYVPAPYTSKIDPLTG
FVDPFVWKTIKNHESRKHFLEGFDFLHYDVKTGDFILHFKMNRNLSFQRGLPGFMPAWDIVFEKNETQFDAKGTPFI
AGKRIVPVIENHRFTGYRDLYPANELIALLEEKGIVFRDGSNILPKLLENDDSHAIDTMVALIRSVLQMRNSNAAT
GEDYINSPVRDLNGVCFDSRFQNPEWPMDADANGAYHIALKGQLLLNHLKESKDLKLQNGISNQDWLAYIQELRN
APA*MVSKGEELFTGVVPILVELDGDVNGHKFSVSGEGEGDATYGKLTLKFICTTGKLPVPWPTLVTTLTYGVQCFS*
*RYPDHMKQHDFFKSAMPEGYVQERTIFFKDDGNYKTRAEVKFEGDTLVNRIELKGIDFKEDGNILGHKLEYNYNSH*
*NVYIMADKQKNGIKVNFKIRHNIEDGSVQLADHYQQNTPIGDGPVLLPDNHYLSTQSALSKDPNEKRDHMVLLEFV*
*TAAGITLGMDELYK*

SEQ ID NO: 112
MTQFEGFTNLYQVSKTLRFELIPQGKTLKHIQEQGFIEEDKARNDHYKELKPIIDRIYKTYADQCLQLVQLDWENLS
AAIDSYRKEKTEETRNALIEEQATYRNAIHDYFIGRTDNLTDAINKRHAEIYKGLFKAELFNGKVLKQLGTVTTTEH
ENALLRSFDKFTTYFSGFYENRKNVFSAEDISTAIPHRIVQDNFPKFKENCHIFTRLITAVPSLREHFENVKKAIGI
FVSTSIEEVFSPPFYNQLLTQTQIDLYNQLLGGISREAGTEKIKGLNEVLNLAIQKNDETAHIIASLPHRFIPLFKQ
ILSDRNTLSFILEEFKSDEEVIQSFCKYKTLLRNENVLETAEALFNELNSIDLTHIFISHKKLETISSALCDHWDTL
RNALYERRISELTGKITKSAKEKVQRSLKHEDINLQEIISAAGKELSEAFKQKTSEILSHAHAALDQPLPTTLKKQE
EKEILKSQLDSLLGLYHLLDWFAVDESNEVDPEFSARLTGIKLEMEPSLSFYNKARNYATKKPYSVEKFKLNFQMPT
LASGWDVNKEKNNGAILFVKNGLYYLGIMPKQKGRYKALSFEPTEKTSEGFDKMYYDYFPDAAKMIPKCSTQLKAVT
AHFQTHTTPILLSNNFIEPLEITKEIYDLNNPEKEPKKFQTAYAKKTGDQKGYREALCKWIDFTRDFLSKYTKTTSI
DLSSLRPSSQYKDLGEYYAELNPLLYHISFQRIAEKEIMDAVETGKLYLFQIYNKDFAKGHHGKPNLHTLYWTGLFS
PENLAKTSIKLNGQAELFYRPKSRMKRMAHRLGEKMLNKKLKDQKTPIPDTLYQELYDYVNHRLSHDLSDEARALLP
NVITKEVSHEIIKDRRFTSDKFFFHVPITLNYQAANSPSKFNQRVNAYLKEHPETPIIGIDRGERNLIYITVIDSTG
KILEQRSLNTIQQFDYQKKLDNREKERVAARQAWSVVGTIKDLKQGYLSQVIHEIVDLMIHYQAVVVLENLNFGFKS
KRTGIAEKAVYQQFEKMLIDKLNCLVLKDYPAEKVGGVLNPYQLTDQFTSFAKMGTQSGFLFYVPAPYTSKIDPLTG
FVDPFVWKTIKNHESRKHFLEGFDFLHYDVKTGDFILHFKMNRNLSFQRGLPGFMPAWDIVFEKNETQFDAKGTPFI
AGKRIVPVIENHRFTGYRDLYPANELIALLEEKGIVFRDGSNILPKLLENDDSHAIDTMVALIRSVLQMRNSNAAT
GEDYINSPVRDLNGVCFDSRFQNPEWPMDADANGAYHIALKGQLLLNHLKESKDLKLQNGISNQDWLAYIQELRN
APAPA*MVSKGEELFTGVVPILVELDGDVNGHKFSVSGEGEGDATYGKLTLKFICTTGKLPVPWPTLVTTLTYGVQC*
*FSRYPDHMKQHDFFKSAMPEGYVQERTIFFKDDGNYKTRAEVKFEGDTLVNRIELKGIDFKEDGNLGHKLEYNYN*
*SHNVYIMADKQKNGIKVNFKIRHNIEDGSVQLADHYQQNTPIGDGPVLLPDNHYLSTQSALSKDPNEKRDHMVLLE*
*FVTAAGITLGMDELYK*

SEQ ID NO: 113
MTQFEGFTNLYQVSKTLRFELIPQGKTLKHIQEQGFIEEDKARNDHYKELKPIIDRIYKTYADQCLQLVQLDWENLS
AAIDSYRKEKTEETRNALIEEQATYRNAIHDYFIGRTDNLTDAINKRHAEIYKGLFKAELFNGKVLKQLGTVTTTEH
ENALLRSFDKFTTYFSGFYENRKNVFSAEDISTAIPHRIVQDNFPKFKENCHIFTRLITAVPSLREHFENVKKAIGI
FVSTSIEEVFSPPFYNQLLTQTQIDLYNQLLGGISREAGTEKIKGLNEVLNLAIQKNDETAHIIASLPHRFIPLFKQ
ILSDRNTLSFILEEFKSDEEVIQSFCKYKTLLRNENVLETAEALFNELNSIDLTHIFISHKKLETISSALCDHWDTL
RNALYERRISELTGKITKSAKEKVQRSLKHEDINLQEIISAAGKELSEAFKQKTSEILSHAHAALDQPLPTTLKKQE
EKEILKSQLDSLLGLYHLLDWFAVDESNEVDPEFSARLTGIKLEMEPSLSFYNKARNYATKKPYSVEKFKLNFQMPT
LASGWDVNKEKNNGAILFVKNGLYYLGIMPKQKGRYKALSFEPTEKTSEGFDKMYYDYFPDAAKMIPKCSTQLKAVT
AHFQTHTTPILLSNNFIEPLEITKEIYDLNNPEKEPKKFQTAYAKKTGDQKGYREALCKWIDFTRDFLSKYTKTTSI
DLSSLRPSSQYKDLGEYYAELNPLLYHISFQRIAEKEIMDAVETGKLYLFQIYNKDFAKGHHGKPNLHTLYWTGLFS
PENLAKTSIKLNGQAELFYRPKSRMKRMAHRLGEKMLNKKLKDQKTPIPDTLYQELYDYVNHRLSHDLSDEARALLP
NVITKEVSHEIIKDRRFTSDKFFFHVPITLNYQAANSPSKFNQRVNAYLKEHPETPIIGIDRGERNLIYITVIDSTG
KILEQRSLNTIQQFDYQKKLDNREKERVAARQAWSVVGTIKDLKQGYLSQVIHEIVDLMIHYQAVVVLENLNFGFKS
KRTGIAEKAVYQQFEKMLIDKLNCLVLKDYPAEKVGGVLNPYQLTDQFTSFAKMGTQSGFLFYVPAPYTSKIDPLTG
FVDPFVWKTIKNHESRKHFLEGFDFLHYDVKTGDFILHFKMNRNLSFQRGLPGFMPAWDIVFEKNETQFDAKGTPFI
AGKRIVPVIENHRFTGYRDLYPANELIALLEEKGIVFRDGSNILPKLLENDDSHAIDTMVALIRSVLQMRNSNAAT
GEDYINSPVRDLNGVCFDSRFQNPEWPMDADANGAYHIALKGQLLLNHLKESKDLKLQNGISNQDWLAYIQELRN
APAPAPA*MVSKGEELFTGVVPILVELDGDVNGHKFSVSGEGEGDATYGKLTLKFICTTGKLPVPWPTLVTTLTYGV*
*QCFSRYPDHMKQHDFFKSAMPEGYVQERTIFFKDDGNYKTRAEVKFEGDTLVNRIELKGIDFKEDGNILGHKLEYN*
*YNSHNVYIMADKQKNGIKVNFKIRHNIEDGSVQLADHYQQNTPIGDGPVLLPDNHYLSTQSALSKDPNEKRDHMVL*
*LEFVTAAGITLGMDELYK*

SEQ ID NO: 114
MTQFEGFTNLYQVSKTLRFELIPQGKTLKHIQEQGFIEEDKARNDHYKELKPIIDRIYKTYADQCLQLVQLDWENLS
AAIDSYRKEKTEETRNALIEEQATYRNAIHDYFIGRTDNLTDAINKRHAEIYKGLFKAELFNGKVLKQLGTVTTTEH
ENALLRSFDKFTTYFSGFYENRKNVFSAEDISTAIPHRIVQDNFPKFKENCHIFTRLITAVPSLREHFENVKKAIGI
FVSTSIEEVFSPPFYNQLLTQTQIDLYNQLLGGISREAGTEKIKGLNEVLNLAIQKNDETAHIIASLPHRFIPLFKQ
ILSDRNTLSFILEEFKSDEEVIQSFCKYKTLLRNENVLETAEALFNELNSIDLTHIFISHKKLETISSALCDHWDTL
RNALYERRISELTGKITKSAKEKVQRSLKHEDINLQEIISAAGKELSEAFKQKTSEILSHAHAALDQPLPTTLKKQE
EKEILKSQLDSLLGLYHLLDWFAVDESNEVDPEFSARLTGIKLEMEPSLSFYNKARNYATKKPYSVEKFKLNFQMPT
LASGWDVNKEKNNGAILFVKNGLYYLGIMPKQKGRYKALSFEPTEKTSEGFDKMYYDYFPDAAKMIPKCSTQLKAVT
AHFQTHTTPILLSNNFIEPLEITKEIYDLNNPEKEPKKFQTAYAKKTGDQKGYREALCKWIDFTRDFLSKYTKTTSI
DLSSLRPSSQYKDLGEYYAELNPLLYHISFQRIAEKEIMDAVETGKLYLFQIYNKDFAKGHHGKPNLHTLYWTGLFS
PENLAKTSIKLNGQAELFYRPKSRMKRMAHRLGEKMLNKKLKDQKTPIPDTLYQELYDYVNHRLSHDLSDEARALLP

TABLE V.3-continued

AsCas12a-Linker-eGFP Chimeras

NVITKEVSHEIIKDRRFTSDKFFFHVPITLNYQAANSPSKFNQRVNAYLKEHPETPIIGIDRGERNLIYITVIDSTG
KILEQRSLNTIQQFDYQKKLDNREKERVAARQAWSVVGTIKDLKQGYLSQVIHEIVDLMIHYQAVVVLENLNFGFKS
KRTGIAEKAVYQQFEKMLIDKLNCLVLKDYPAEKVGGVLNPYQLTDQFTSFAKMGTQSGFLFYVPAPYTSKIDPLTG
FVDPFVWKTIKNHESRKHFLEGFDFLHYDVKTGDFILHFKMNRNLSFQRGLPGFMPAWDIVFEKNETQFDAKGTPFI
AGKRIVPVIENHRFTGYRDLYPANELIALLEEKGIVFRDGSNILPKLLENDDSHAIDTMVALIRSVLQMRNSNAAT
GEDYINSPVRDLNGVCFDSRFQNPEWPMDADANGAYHIALKGQLLLNHLKESKDLKLQNGISNQDWLAYIQELRN
APAPAPAPA*NVSKGEELFTGVVPILVELDGDVNGHKFSVSGEGEGDATYGKLTLKFICTTGKLPVPWPTLVTTLTY
GVQCFSRYPDHMKQHDFFKSAMPEGYVQERTIFFKDDGNYKTRAEVKFEGDTLVNRIELKGIDFKEDGNILGHKLE
YNYNSHNVYIMADKQKNGIKVNFKIRHNIEDGSVQLADHYQQNTPIGDGPVLLPDNHYLSTQSALSKDPNEKRDHM
VLLEFVTAAGITLGMDELYK*

SEQ ID NO: 115
MTQFEGFTNLYQVSKTLRFELIPQGKTLKHIQEQGFIEEDKARNDHYKELKPIIDRIYKTYADQCLQLVQLDWENLS
AAIDSYRKEKTEETRNALIEEQATYRNAIHDYFIGRTDNLTDAINKRHAEIYKGLFKAELFNGKVLKQLGTVTTTEH
ENALLRSFDKFTTYFSGFYENRKNVFSAEDISTAIPHRIVQDNFPKFKENCHIFTRLITAVPSLREHFENVKKAIGI
FVSTSIEEVFSFPFYNQLLTQTQIDLYNQLLGGISREAGTEKIKGLNEVLNLAIQKNDETAHIIASLPHRFIPLFKQ
ILSDRNTLSFILEEFKSDEEVIQSFCKYKTLLRNENVLETAEALFNELNSIDLTHIFISHKKLETISSALCDHWDTL
RNALYERRISELTGKITKSAKEKVQRSLKHEDINLQEIISAAGKELSEAFKQKTSEILSHAHAALDQPLPTTLKKQE
EKEILKSQLDSLLGLYHLLDWFAVDESNEVDPEFSARLTGIKLEMEPSLSFYNKARNYATKKPYSVEKFKLNFQMPT
LASGWDVNKEKNNGAILFVKNGLYYLGIMPKQGRYKALSFEPTEKTSEGFDKMYYDYFPDAAKMIPKCSTQLKAVT
AHFQTHTTPILLSNNFIEPLEITKEIYDLNNPEKEPKKFQTAYAKKTGDQKGYREALCKWIDFTRDFLSKYTKTTSI
DLSSLRPSSQYKDLGEYYAELNPLLYHISFQRIAEKEIMDAVETGKLYLFQIYNKDFAKGHHGKPNLHTLYWTGLFS
PENLAKTSIKLNGQAELFYRPKSRMKRMAHRLGEKMLNKKLKDQKTPIPDTLYQELYDYVNHRLSHDLSDEARALLP
NVITKEVSHEIIKDRRFTSDKFFFHVPITLNYQAANSPSKFNQRVNAYLKEHPETPIIGIDRGERNLIYITVIDSTG
KILEQRSLNTIQQFDYQKKLDNREKERVAARQAWSVVGTIKDLKQGYLSQVIHEIVDLMIHYQAVVVLENLNFGFKS
KRTGIAEKAVYQQFEKMLIDKLNCLVLKDYPAEKVGGVLNPYQLTDQFTSFAKMGTQSGFLFYVPAPYTSKIDPLTG
FVDPFVWKTIKNHESRKHFLEGFDFLHYDVKTGDFILHFKMNRNLSFQRGLPGFMPAWDIVFEKNETQFDAKGTPFI
AGKRIVPVIENHRFTGYRDLYPANELIALLEEKGIVFRDGSNILPKLLENDDSHAIDTMVALIRSVLQMRNSNAAT
GEDYINSPVRDLNGVCFDSRFQNPEWPMDADANGAYHIALKGQLLLNHLKESKDLKLQNGISNQDWLAYIQELRN
APAPAPAPA*MVSKGEELFTGVVPILVELDGDVNGHKFSVSGEGEGDATYGKLTLKFICTTGKLPVPWPTLVTTL
TYGVQCFSRYPDHMKQHDFFKSAMPEGYVQERTIFFKDDGNYKTRAEVKFEGDTLVNRIELKGIDFKEDGNIGHK
LEYNYNSHNVYIMADKQKNGIKVNFKIRHNIEDGSVQLADHYQQNTPIGDGPVLLPDNHYLSTQSALSKDPNEKRD
HMVLLEFVTAAGITLGMDELYK*

SEQ ID NO: 116
MTQFEGFTNLYQVSKTLRFELIPQGKTLKHIQEQGFIEEDKARNDHYKELKPIIDRIYKTYADQCLQLVQLDWENLS
AAIDSYRKEKTEETRNALIEEQATYRNAIHDYFIGRTDNLTDAINKRHAEIYKGLFKAELFNGKVLKQLGTVTTTEH
ENALLRSFDKFTTYFSGFYENRKNVFSAEDISTAIPHRIVQDNFPKFKENCHIFTRLITAVPSLREHFENVKKAIGI
FVSTSIEEVFSFPFYNQLLTQTQIDLYNQLLGGISREAGTEKIKGLNEVLNLAIQKNDETAHIIASLPHRFIPLFKQ
ILSDRNTLSFILEEFKSDEEVIQSFCKYKTLLRNENVLETAEALFNELNSIDLTHIFISHKKLETISSALCDHWDTL
RNALYERRISELTGKITKSAKEKVQRSLKHEDINLQEIISAAGKELSEAFKQKTSEILSHAHAALDQPLPTTLKKQE
EKEILKSQLDSLLGLYHLLDWFAVDESNEVDPEFSARLTGIKLEMEPSLSFYNKARNYATKKPYSVEKFKLNFQMPT
LASGWDVNKEKNNGAILFVKNGLYYLGIMPKQGRYKALSFEPTEKTSEGFDKMYYDYFPDAAKMIPKCSTQLKAVT
AHFQTHTTPILLSNNFIEPLEITKEIYDLNNPEKEPKKFQTAYAKKTGDQKGYREALCKWIDFTRDFLSKYTKTTSI
DLSSLRPSSQYKDLGEYYAELNPLLYHISFQRIAEKEIMDAVETGKLYLFQIYNKDFAKGHHGKPNLHTLYWTGLFS
PENLAKTSIKLNGQAELFYRPKSRMKRMAHRLGEKMLNKKLKDQKTPIPDTLYQELYDYVNHRLSHDLSDEARALLP
NVITKEVSHEIIKDRRFTSDKFFFHVPITLNYQAANSPSKFNQRVNAYLKEHPETPIIGIDRGERNLIYITVIDSTG
KILEQRSLNTIQQFDYQKKLDNREKERVAARQAWSVVGTIKDLKQGYLSQVIHEIVDLMIHYQAVVVLENLNFGFKS
KRTGIAEKAVYQQFEKMLIDKLNCLVLKDYPAEKVGGVLNPYQLTDQFTSFAKMGTQSGFLFYVPAPYTSKIDPLTG
FVDPFVWKTIKNHESRKHFLEGFDFLHYDVKTGDFILHFKMNRNLSFQRGLPGFMPAWDIVFEKNETQFDAKGTPFI
AGKRIVPVIENHRFTGYRDLYPANELIALLEEKGIVFRDGSNILPKLLENDDSHAIDTMVALIRSVLQMRNSNAAT
GEDYINSPVRDLNGVCFDSRFQNPEWPMDADANGAYHIALKGQLLLNHLKESKDLKLQNGISNQDWLAYIQELRN
APAPAPAPA*MVSKGEELFTGVVPILVELDGDVNGHKFSVSGEGEGDATYGKLTIKFICTTGKLPVPWPTLVT
TLTYGVQCFSRYPDHMKQHDFFKSAMPEGYVQERTIFFKDDGNYKTRAEVKFEGDTLVNRIELKGIDFKEDGNILG
HKLEYNYNSHNVYIMADKQKNGIKVNFKIRHNIEDGSVQLADHYQQNTPIGDGPVLLPDNHYLSTQSALSKDPNEK
RDHMVLLEFVTAAGITLGMDELYK*

SEQ ID NO: 117
MTQFEGFTNLYQVSKTLRFELIPQGKTLKHIQEQGFIEEDKARNDHYKELKPIIDRIYKTYADQCLQLVQLDWENLS
AAIDSYRKEKTEETRNALIEEQATYRNAIHDYFIGRTDNLTDAINKRHAEIYKGLFKAELFNGKVLKQLGTVTTTEH
ENALLRSFDKFTTYFSGFYENRKNVFSAEDISTAIPHRIVQDNFPKFKENCHIFTRLITAVPSLREHFENVKKAIGI
FVSTSIEEVFSFPFYNQLLTQTQIDLYNQLLGGISREAGTEKIKGLNEVLNLAIQKNDETAHIIASLPHRFIPLFKQ
ILSDRNTLSFILEEFKSDEEVIQSFCKYKTLLRNENVLETAEALFNELNSIDLTHIFISHKKLETISSALCDHWDTL
RNALYERRISELTGKITKSAKEKVQRSLKHEDINLQEIISAAGKELSEAFKQKTSEILSHAHAALDQPLPTTLKKQE
EKEILKSQLDSLLGLYHLLDWFAVDESNEVDPEFSARLTGIKLEMEPSLSFYNKARNYATKKPYSVEKFKLNFQMPT
LASGWDVNKEKNNGAILFVKNGLYYLGIMPKQGRYKALSFEPTEKTSEGFDKMYYDYFPDAAKMIPKCSTQLKAVT
AHFQTHTTPILLSNNFIEPLEITKEIYDLNNPEKEPKKFQTAYAKKTGDQKGYREALCKWIDFTRDFLSKYTKTTSI
DLSSLRPSSQYKDLGEYYAELNPLLYHISFQRIAEKEIMDAVETGKLYLFQIYNKDFAKGHHGKPNLHTLYWTGLFS
PENLAKTSIKLNGQAELFYRPKSRMKRMAHRLGEKMLNKKLKDQKTPIPDTLYQELYDYVNHRLSHDLSDEARALLP
NVITKEVSHEIIKDRRFTSDKFFFHVPITLNYQAANSPSKFNQRVNAYLKEHPETPIIGIDRGERNLIYITVIDSTG
KILEQRSLNTIQQFDYQKKLDNREKERVAARQAWSVVGTIKDLKQGYLSQVIHEIVDLMIHYQAVVVLENLNFGFKS
KRTGIAEKAVYQQFEKMLIDKLNCLVLKDYPAEKVGGVLNPYQLTDQFTSFAKMGTQSGFLFYVPAPYTSKIDPLTG
FVDPFVWKTIKNHESRKHFLEGFDFLHYDVKTGDFILHFKMNRNLSFQRGLPGFMPAWDIVFEKNETQFDAKGTPFI
AGKRIVPVIENHRFTGYRDLYPANELIALLEEKGIVFRDGSNILPKLLENDDSHAIDTMVALIRSVLQMRNSNAAT
GEDYINSPVRDLNGVCFDSRFQNPEWPMDADANGAYHIALKGQLLLNHLKESKDLKLQNGISNQDWLAYIQELRN

TABLE V.3-continued

AsCas12a-Linker-eGFP Chimeras

APAPAPAPAPAPAPAPA*MVSKGEELFTGVVPILVELDGDVNGHKFSVSGEGEGDATYGKLTLKFICTTGKLPVPWPTL*
*VTTLTYGVQCFSRYPDHMKQHDFFKSAMPEGYVQERTIFFKDDGNYKTRAEVKFEGDTLVNRIELKGIDFKEDGNI*
*LGHKLEYNYNSHNVYIMADKQKNGIKVNFKIRHNIEDGSVQLADHYQQNTPIGDGPVLLPDNHYLSTQSALSKDPN*
*EKRDHMVLLEFVTAAGITLGMDELYK*

SEQ ID NO: 118
MTQFEGFTNLYQVSKTLRFELIPQGKTLKHIQEQGFIEEDKARNDHYKELKPIIDRIYKTYADQCLQLVQLDWENLS
AAIDSYRKEKTEETRNALIEEQATYRNAIHDYFIGRTDNLTDAINKRHAEIYKGLFKAELFNGKVLKQLGTVTTTEH
ENALLRSFDKFTTYFSGFYENRKNVFSAEDISTAIPHRIVQDNFPKFKENCHIFTRLITAVPSLREHFENVKKAIGI
FVSTSIEEVFSFPFYNQLLTQTQIDLYNQLLGGISREAGTEKIKGLNEVLNLAIQKNDETAHIIASLPHRFIPLFKQ
ILSDRNTLSFILEEFKSDEEVIQSFCKYKTLLRNENVLETAEALFNELNSIDLTHIFISHKKLETISSALCDHWDTL
RNALYERRISELTGKITKSAKEKVQRSLKHEDINLQEIISAAGKELSEAFKQKTSEILSHAHAALDQPLPTTLKKQE
EKEILKSQLDSLLGLYHLLDWFAVDESNEVDPEFSARLTGIKLEMEPSLSFYNKARNYATKKPYSVEKFKLNFQMPT
LASGWDVNKEKNNGAILFVKNGLYYLGIMPKQKGRYKALSFEPTEKTSEGFDKMYYDYFPDAAKMIPKCSTQLKAVT
AHFQTHTTPILLSNNFIEPLEITKEIYDLNNPEKEPKKFQTAYAKKTGDQKGYREALCKWIDFTRDFLSKYTKTTSI
DLSSLRPSSQYKDLGEYYAELNPLLYHISFQRIAEKEIMDAVETGKLYLFQIYNKDFAKGHHGKPNLHTLYWTGLFS
PENLAKTSIKLNGQAELFYRPKSRMKRMAHRLGEKMLNKKLKDQKTPIPDTLYQELYDYVNHRLSHDLSDEARALLP
NVITKEVSHEIIKDRRFTSDKFFFHVPITLNYQAANSPSKFNQRVNAYLKEHPETPIIGIDRGERNLIYITVIDSTG
KILEQRSLNTIQQFDYQKKLDNREKERVAARQAWSVVGTIKDLKQGYLSQVIHEIVDLMIHYQAVVVLENLNFGFKS
KRTGIAEKAVYQQFEKMLIDKLNCLVLKDYPAEKVGGVLNPYQLTDQFTSFAKMGTQSGFLFYVPAPYTSKIDPLTG
FVDPFVWKTIKNHESRKHFLEGFDFLHYDVKTGDFILHFKMNRNLSFQRGLPGFMPAWDIVFEKNETQFDAKGTPFI
AGKRIVPVIENHRFTGYRDLYPANELIALLEEKGIVFRDGSNILPKLLENDDSHAIDTMVALIRSVLQMRNSNAAT
GEDYINSPVRDLNGVCFDSRFQNPEWPMDADANGAYHIALKGQLLNHLKESKDLKLQNGISNQDWLAYIQELRN
APAPAPAPAPAPAPAPA*MVSKGEELFTGVVPILVELDGDVNGHKFSVSGEGEGDATYGKLTLKFICTTGKLPVPWP*
*TLVTTLTYGVQCFSRYPDHMKQHDFFKSAMPEGYVQERTIFFKDDGNYKTRAEVKFEGDTLVNRIELKGIDFKEDG*
*NILGHKLEYNYNSHNVYIMADKQKNGIKNFKIRHNIEDGSVQLADHYQQNTPIGD*
*GPVLLPDNHYLSTQSALSKDPNEKRDHMVLLEFVTAAGITLGMDELYK*

SEQ ID NO: 119
MTQFEGFTNLYQVSKTLRFELIPQGKTLKHIQEQGFIEEDKARNDHYKELKPIIDRIYKTYADQCLQLVQLDWENLS
AAIDSYRKEKTEETRNALIEEQATYRNAIHDYFIGRTDNLTDAINKRHAEIYKGLFKAELFNGKVLKQLGTVTTTEH
ENALLRSFDKFTTYFSGFYENRKNVFSAEDISTAIPHRIVQDNFPKFKENCHIFTRLITAVPSLREHFENVKKAIGI
FVSTSIEEVFSFPFYNQLLTQTQIDLYNQLLGGISREAGTEKIKGLNEVLNLAIQKNDETAHIIASLPHRFIPLFKQ
ILSDRNTLSFILEEFKSDEEVIQSFCKYKTLLRNENVLETAEALFNELNSIDLTHIFISHKKLETISSALCDHWDTL
RNALYERRISELTGKITKSAKEKVQRSLKHEDINLQEIISAAGKELSEAFKQKTSEILSHAHAALDQPLPTTLKKQE
EKEILKSQLDSLLGLYHLLDWFAVDESNEVDPEFSARLTGIKLEMEPSLSFYNKARNYATKKPYSVEKFKLNFQMPT
LASGWDVNKEKNNGAILFVKNGLYYLGIMPKQKGRYKALSFEPTEKTSEGFDKMYYDYFPDAAKMIPKCSTQLKAVT
AHFQTHTTPILLSNNFIEPLEITKEIYDLNNPEKEPKKFQTAYAKKTGDQKGYREALCKWIDFTRDFLSKYTKTTSI
DLSSLRPSSQYKDLGEYYAELNPLLYHISFQRIAEKEIMDAVETGKLYLFQIYNKDFAKGHHGKPNLHTLYWTGLFS
PENLAKTSIKLNGQAELFYRPKSRMKRMAHRLGEKMLNKKLKDQKTPIPDTLYQELYDYVNHRLSHDLSDEARALLP
NVITKEVSHEIIKDRRFTSDKFFFHVPITLNYQAANSPSKFNQRVNAYLKEHPETPIIGIDRGERNLIYITVIDSTG
KILEQRSLNTIQQFDYQKKLDNREKERVAARQAWSVVGTIKDLKQGYLSQVIHEIVDLMIHYQAVVVLENLNFGFKS
KRTGIAEKAVYQQFEKMLIDKLNCLVLKDYPAEKVGGVLNPYQLTDQFTSFAKMGTQSGFLFYVPAPYTSKIDPLTG
FVDPFVWKTIKNHESRKHFLEGFDFLHYDVKTGDFILHFKMNRNLSFQRGLPGFMPAWDIVFEKNETQFDAKGTPFI
AGKRIVPVIENHRFTGYRDLYPANELIALLEEKGIVFRDGSNILPKLLENDDSHAIDTMVALIRSVLQMRNSNAAT
GEDYINSPVRDLNGVCFDSRFQNPEWPMDADANGAYHIALKGQLLNHLKESKDLKLQNGISNQDWLAYIQELRN
APAPAPAPAPAPAPAPA*MVSKGEELFTGVVPILVELDGDVNGHKFSVSGEGEGDATYGKL*
*TLKFICTTGKLPVPWPTLVTTLTYGVQCFSRYPDHMK*
*QHDFFKSAMPEGYVQERTIFFKDDGNYKTRAEVKFEGDTLVNRIELKGIDFKE*
*DGNILGHKLEYNYNSHNVYIMADKQKNGIKVNFKIRHNIEDGSVQLADHYQQNTP*
*IGDGPVLLPDNHYLSTQSALSKDPNEKRDHMVLLEFVTAAGITLGMDELYK*

SEQ ID NO: 120
MTQFEGFTNLYQVSKTLRFELIPQGKTLKHIQEQGFIEEDKARNDHYKELKPIIDRIYKTYADQCLQLVQLDWENLS
AAIDSYRKEKTEETRNALIEEQATYRNAIHDYFIGRTDNLTDAINKRHAEIYKGLFKAELFNGKVLKQLGTVTTTEH
ENALLRSFDKFTTYFSGFYENRKNVFSAEDISTAIPHRIVQDNFPKFKENCHIFTRLITAVPSLREHFENVKKAIGI
FVSTSIEEVFSFPFYNQLLTQTQIDLYNQLLGGISREAGTEKIKGLNEVLNLAIQKNDETAHIIASLPHRFIPLFKQ
ILSDRNTLSFILEEFKSDEEVIQSFCKYKTLLRNENVLETAEALFNELNSIDLTHIFISHKKLETISSALCDHWDTL
RNALYERRISELTGKITKSAKEKVQRSLKHEDINLQEIISAAGKELSEAFKQKTSEILSHAHAALDQPLPTTLKKQE
EKEILKSQLDSLLGLYHLLDWFAVDESNEVDPEFSARLTGIKLEMEPSLSFYNKARNYATKKPYSVEKFKLNFQMPT
LASGWDVNKEKNNGAILFVKNGLYYLGIMPKQKGRYKALSFEPTEKTSEGFDKMYYDYFPDAAKMIPKCSTQLKAVT
AHFQTHTTPILLSNNFIEPLEITKEIYDLNNPEKEPKKFQTAYAKKTGDQKGYREALCKWIDFTRDFLSKYTKTTSI
DLSSLRPSSQYKDLGEYYAELNPLLYHISFQRIAEKEIMDAVETGKLYLFQIYNKDFAKGHHGKPNLHTLYWTGLFS
PENLAKTSIKLNGQAELFYRPKSRMKRMAHRLGEKMLNKKLKDQKTPIPDTLYQELYDYVNHRLSHDLSDEARALLP
NVITKEVSHEIIKDRRFTSDKFFFHVPITLNYQAANSPSKFNQRVNAYLKEHPETPIIGIDRGERNLIYITVIDSTG
KILEQRSLNTIQQFDYQKKLDNREKERVAARQAWSVVGTIKDLKQGYLSQVIHEIVDLMIHYQAVVVLENLNFGFKS
KRTGIAEKAVYQQFEKMLIDKLNCLVLKDYPAEKVGGVLNPYQLTDQFTSFAKMGTQSGFLFYVPAPYTSKIDPLTG
FVDPFVWKTIKNHESRKHFLEGFDFLHYDVKTGDFILHFKMNRNLSFQRGLPGFMPAWDIVFEKNETQFDAKGTPFI
AGKRIVPVIENHRFTGYRDLYPANELIALLEEKGIVFRDGSNILPKLLENDDSHAIDTMVALIRSVLQMRNSNAAT
GEDYINSPVRDLNGVCFDSRFQNPEWPMDADANGAYHIALKGQLLNHLKESKDLKLQNGISNQDWLAYIQELRN
APAPAPAPAPAPAPAPA*MVSKGEELFTGVVPILVELDGDVNGHK*
*FSVSGEGEGDATYGKLTLKFICTTGKLPVPWPTLVTTLTYGVQCFSRYPDHMKQHD*
*FFKSAMPEGYVQERTIFFKDDGNYKTRAEVKFEGDTLVNRIELKGIDF*
*KEDGNILGHKLEYNYNSHNVYIMADKQKNGIKVNFKIRHNIEDGSVQLADHYQQNTP*
*IGDGPVLLPDNHYLSTQSALSKDPNEKRDHMVLLEFVTAAGITLGMDELYK*

TABLE V.3-continued

AsCas12a-Linker-eGFP Chimeras

SEQ ID NO: 121
MTQFEGFTNLYQVSKTLRFELIPQGKTLKHIQEQGFIEEDKARNDHYKELKPIIDRIYKTYADQCLQLVQLDWENLS
AAIDSYRKEKTEETRNALIEEQATYRNAIHDYFIGRTDNLTDAINKRHAEIYKGLFKAELFNGKVLKQLGTVTTTEH
ENALLRSFDKFTTYFSGFYENRKNVFSAEDISTAIPHRIVQDNFPKFKENCHIFTRLITAVPSLREHFENVKKAIGI
FVSTSIEEVFSPPFYNQLLTQTQIDLYNQLLGGISREAGTEKIKGLNEVLNLAIQKNDETAHIIASLPHRFIPLFKQ
ILSDRNTLSFILEEFKSDEEVIQSFCKYKTLLRNENVLETAEALFNELNSIDLTHIFISHKKLETISSALCDHWDTL
RNALYERRISELTGKITKSAKEKVQRSLKHEDINLQEIISAAGKELSEAFKQKTSEILSHAHAALDQPLPTTLKKQE
EKEILKSQLDSLLGLYHLLDWFAVDESNEVDPEFSARLTGIKLEMEPSLSFYNKARNYATKKPYSVEKFKLNFQMPT
LASGWDVNKEKNNGAILFVKNGLYYLGIMPKQKGRYKALSFEPTEKTSEGFDKMYYDYFPDAAKMIPKCSTQLKAVT
AHFQTHTTPILLSNNFIEPLEITKEIYDLNNPEKEPKKFQTAYAKKTGDQKGYREALCKWIDFTRDFLSKYTKTTSI
DLSSLRPSSQYKDLGEYYAELNPLLYHISFQRIAEKEIMDAVETGKLYLFQIYNKDFAKGHHGKPNLHTLYWTGLFS
PENLAKTSIKLNGQAELFYRPKSRMKRMAHRLGEKMLNKKLKDQKTPIPDTLYQELYDYVNHRLSHDLSDEARALLP
NVITKEVSHEIIKDRRFTSDKFFFHVPITLNYQAANSPSKFNQRVNAYLKEHPETPIIGIDRGERNLIYITVIDSTG
KILEQRSLNTIQQFDYQKKLDNREKERVAARQAWSVVGTIKDLKQGYLSQVIHEIVDLMIHYQAVVVLENLNFGFKS
KRTGIAEKAVYQQFEKMLIDKLNCLVLKDYPAEKVGGVLNPYQLTDQFTSFAKMGTQSGFLFYVPAPYTSKIDPLTG
FVDPFVWKTIKNHESRKHFLEGFDFLHYDVKTGDFILHFKMNRNLSFQRGLPGFMPAWDIVFEKNETQFDAKGTPFI
AGKRIVPVIENHRFTGRYRDLYPANELIALLEEKGIVFRDGSNILPKLLENDDSHAIDTMVALIRSVLQMRSNAAT
GEDYINSPVRDLNGVCFDSRFQNPEWPMDADANGAYHIALKGQLLLNHLKESKDLKLQNGISNQDWLAYIQELRN
APAPAPAPAPAPAPAPAPAPAPA*MVSKGEELFTGVVPILVELDGDVNGHKFSVSGEGEGDATYGKLTLKFICTTGK
LPVPWPTLVTTLTYGVQCFSRYPDHMKQHDFFKSAMPEGYVQERTIFFKDDGNYKTRAEVKFEGDTLVNRIELKGI
DFKEDGNILGHKLEYNYNSHNVYIMADKQKNGIKVNFKIRHNIEDGSVQLADHYQQNTPIGDGPVLLPDNHYLSTQ
SALSKDPNEKRDHMVLLEFVTAAGITLGMDELYK*

SEQ ID NO: 122
MTQFEGFTNLYQVSKTLRFELIPQGKTLKHIQEQGFIEEDKARNDHYKELKPIIDRIYKTYADQCLQLVQLDWENLS
AAIDSYRKEKTEETRNALIEEQATYRNAIHDYFIGRTDNLTDAINKRHAEIYKGLFKAELFNGKVLKQLGTVTTTEH
ENALLRSFDKFTTYFSGFYENRKNVFSAEDISTAIPHRIVQDNFPKFKENCHIFTRLITAVPSLREHFENVKKAIGI
FVSTSIEEVFSPPFYNQLLTQTQIDLYNQLLGGISREAGTEKIKGLNEVLNLAIQKNDETAHIIASLPHRFIPLFKQ
ILSDRNTLSFILEEFKSDEEVIQSFCKYKTLLRNENVLETAEALFNELNSIDLTHIFISHKKLETISSALCDHWDTL
RNALYERRISELTGKITKSAKEKVQRSLKHEDINLQEIISAAGKELSEAFKQKTSEILSHAHAALDQPLPTTLKKQE
EKEILKSQLDSLLGLYHLLDWFAVDESNEVDPEFSARLTGIKLEMEPSLSFYNKARNYATKKPYSVEKFKLNFQMPT
LASGWDVNKEKNNGAILFVKNGLYYLGIMPKQKGRYKALSFEPTEKTSEGFDKMYYDYFPDAAKMIPKCSTQLKAVT
AHFQTHTTPILLSNNFIEPLEITKEIYDLNNPEKEPKKFQTAYAKKTGDQKGYREALCKWIDFTRDFLSKYTKTTSI
DLSSLRPSSQYKDLGEYYAELNPLLYHISFQRIAEKEIMDAVETGKLYLFQIYNKDFAKGHHGKPNLHTLYWTGLFS
PENLAKTSIKLNGQAELFYRPKSRMKRMAHRLGEKMLNKKLKDQKTPIPDTLYQELYDYVNHRLSHDLSDEARALLP
NVITKEVSHEIIKDRRFTSDKFFFHVPITLNYQAANSPSKFNQRVNAYLKEHPETPIIGIDRGERNLIYITVIDSTG
KILEQRSLNTIQQFDYQKKLDNREKERVAARQAWSVVGTIKDLKQGYLSQVIHEIVDLMIHYQAVVVLENLNFGFKS
KRTGIAEKAVYQQFEKMLIDKLNCLVLKDYPAEKVGGVLNPYQLTDQFTSFAKMGTQSGFLFYVPAPYTSKIDPLTG
FVDPFVWKTIKNHESRKHFLEGFDFLHYDVKTGDFILHFKMNRNLSFQRGLPGFMPAWDIVFEKNETQFDAKGTPFI
AGKRIVPVIENHRFTGRYRDLYPANELIALLEEKGIVFRDGSNILPKLLENDDSHAIDTMVALIRSVLQMRSNAAT
GEDYINSPVRDLNGVCFDSRFQNPEWPMDADANGAYHIALKGQLLLNHLKESKDLKLQNGISNQDWLAYIQELRN
APAPAPAPAPAPAPAPAPAPAPA*MVSKGEELFTGVVPILVELDGDVNGHKFSVSGEGEGDATYGKLTLKFICTT
GKLPVPWPTLVTTLTYGVQCFSRYPDHMKQHDFFKSAMPEGYVQERTIFFKDDGNYKTRAEVKFEGDTLVNRIELK
GIDFKEDGNILGHKLEYNYNSHNVYIMADKQKNGIKVNFKIRHNIEDGSVQLADHYQQNTPIGDGPVLLPDNHYLS
TQSALSKDPNEKRDHMVLLEFVTAAGITLGMDELYK*

SEQ ID NO: 123
MTQFEGFTNLYQVSKTLRFELIPQGKTLKHIQEQGFIEEDKARNDHYKELKPIIDRIYKTYADQCLQLVQLDWENLS
AAIDSYRKEKTEETRNALIEEQATYRNAIHDYFIGRTDNLTDAINKRHAEIYKGLFKAELFNGKVLKQLGTVTTTEH
ENALLRSFDKFTTYFSGFYENRKNVFSAEDISTAIPHRIVQDNFPKFKENCHIFTRLITAVPSLREHFENVKKAIGI
FVSTSIEEVFSPPFYNQLLTQTQIDLYNQLLGGISREAGTEKIKGLNEVLNLAIQKNDETAHIIASLPHRFIPLFKQ
ILSDRNTLSFILEEFKSDEEVIQSFCKYKTLLRNENVLETAEALFNELNSIDLTHIFISHKKLETISSALCDHWDTL
RNALYERRISELTGKITKSAKEKVQRSLKHEDINLQEIISAAGKELSEAFKQKTSEILSHAHAALDQPLPTTLKKQE
EKEILKSQLDSLLGLYHLLDWFAVDESNEVDPEFSARLTGIKLEMEPSLSFYNKARNYATKKPYSVEKFKLNFQMPT
LASGWDVNKEKNNGAILFVKNGLYYLGIMPKQKGRYKALSFEPTEKTSEGFDKMYYDYFPDAAKMIPKCSTQLKAVT
AHFQTHTTPILLSNNFIEPLEITKEIYDLNNPEKEPKKFQTAYAKKTGDQKGYREALCKWIDFTRDFLSKYTKTTSI
DLSSLRPSSQYKDLGEYYAELNPLLYHISFQRIAEKEIMDAVETGKLYLFQIYNKDFAKGHHGKPNLHTLYWTGLFS
PENLAKTSIKLNGQAELFYRPKSRMKRMAHRLGEKMLNKKLKDQKTPIPDTLYQELYDYVNHRLSHDLSDEARALLP
NVITKEVSHEIIKDRRFTSDKFFFHVPITLNYQAANSPSKFNQRVNAYLKEHPETPIIGIDRGERNLIYITVIDSTG
KILEQRSLNTIQQFDYQKKLDNREKERVAARQAWSVVGTIKDLKQGYLSQVIHEIVDLMIHYQAVVVLENLNFGFKS
KRTGIAEKAVYQQFEKMLIDKLNCLVLKDYPAEKVGGVLNPYQLTDQFTSFAKMGTQSGFLFYVPAPYTSKIDPLTG
FVDPFVWKTIKNHESRKHFLEGFDFLHYDVKTGDFILHFKMNRNLSFQRGLPGFMPAWDIVFEKNETQFDAKGTPFI
AGKRIVPVIENHRFTGRYRDLYPANELIALLEEKGIVFRDGSNILPKLLENDDSHAIDTMVALIRSVLQMRSNAAT
GEDYINSPVRDLNGVCFDSRFQNPEWPMDADANGAYHIALKGQLLLNHLKESKDLKLQNGISNQDWLAYIQELRN
APAPAPAPAPAPAPAPAPAPAPA*MVSKGEELFTGVVPILVELDGDVNGHKFSVSGEGEGDATYGKLTLKFIC
TTGKLPVPWPTLVTTLTYGVQCFSRYPDHMKQHDFFKSAMPEGYVQERTIFFKDDGNYKTRAEVKFEGDTLVNRIE
LKGIDFKEDGNILGHKLEYNYNSHNVYIMADKQKNGIKVNFKIRHNIEDGSVQLADHQQNTPIGDGPVLLPDNHY
LSTQSALSKDPNEKRDHMVLLEFVTAAGITLGMDELYK*

SEQ ID NO: 124
MTQFEGFTNLYQVSKTLRFELIPQGKTLKHIQEQGFIEEDKARNDHYKELKPIIDRIYKTYADQCLQLVQLDWENLS
AAIDSYRKEKTEETRNALIEEQATYRNAIHDYFIGRTDNLTDAINKRHAEIYKGLFKAELFNGKVLKQLGTVTTTEH
ENALLRSFDKETTYFSGFYENRKNVFSAEDISTAIPHRIVQDNFPKFKENCHIFTRLITAVPSLREHFENVKKAIGI
FVSTSIEEVFSPPFYNQLLTQTQIDLYNQLLGGISREAGTEKIKGLNEVLNLAIQKNDETAHIIASLPHRFIPLFKQ
ILSDRNTLSFILEEFKSDEEVIQSFCKYKTLLRNENVLETAEALFNELNSIDLTHIFISHKKLETISSALCDHWDTL
RNALYERRISELTGKITKSAKEKVQRSLKHEDINLQEIISAAGKELSEAFKQKTSEILSHAHAALDQPLPTTLKKQE
EKEILKSQLDSLLGLYHLLDWFAVDESNEVDPEFSARLTGIKLEMEPSLSFYNKARNYATKKPYSVEKFKLNFQMPT

TABLE V.3-continued

AsCas12a-Linker-eGFP Chimeras

```
LASGWDVNKEKNNGAILFVKNGLYYLGIMPKQKGRYKALSFEPTEKTSEGFDKMYYDYFPDAAKMIPKCSTQLKAVT
AHFQTHTTPILLSNNFIEPLEITKEIYDLNNPEKEPKKFQTAYAKKTGDQKGYREALCKWIDFTRDFPLSKYTKTTSI
DLSSLRPSSQYKDLGEYYAELNPLLYHISFQRIAEKEIMDAVETGKLYLFQIYNKDFAKGHHGKPNLHTLYWTGLFS
PENLAKTSIKLNGQAELFYRPKSRMKRMAHRLGEKMLNKKLKDQKTPIPDTLYQELYDYVNHRLSHDLSDEARALLP
NVITKEVSHEIIKDRRFTSDKFFFHVPITLNYQAANSPSKFNQRVNAYLKEHPETPIIGIDRGERNLIYITVIDSTG
KILEQRSLNTIQQFDYQKKLDNREKERVAARQAWSVVGTIKDLKQGYLSQVIHEIVDLMIHYQAVVVLENLNFGFKS
KRTGIAEKAVYQQFEKMLIDKLNCLVLKDYPAEKVGGVLNPYQLTDQFTSFAKMGTQSGFLFYVPAPYTSKIDPLTG
FVDPFVWKTIKNHESRKHFLEGFDFLHYDVKTGDFILHFKMNRNLSFQRGLPGFMPAWDIVFEKNETQFDAKGTPFI
AGKRIVPVIENHRFTGRYRDLYPANELIALLEEKGIVFRDGSNILPKLLENDDSHAIDTMVALIRSVLQMRNSNAAT
GEDYINSPVRDLNGVCFDSRFQNPEWPMDADANGAYHIALKGQLLLNHLKESKDLKLQNGISNQDWLAYIQELRN
APAPAPAPAPAPAPAPAPAPAPAPAPAPAMVSKGEELFTGVVPILVELDGDVNGHKF
SVSGEGEGDATYGKLTLKFICTTGKLPVPWPTLVTTLTYGVQCFSRYP
DHMKQHDFFFKSAMPEGYVQERTIFFKDDGNYKTRAEVKFEGDTLVNRIELKGIDFKEDGNILGHKLEYNYNSHNVY
IMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 125
MTQFEGFTNLYQVSKTLRFELIPQGKTLKHIQEQGFIEEDKARNDHYKELKPIIDRIYKTYADQCLQLVQLDWENLS
AAIDSYRKEKTEETRNALIEEQATYRNAIHDYFIGRTDNLTDAINKRHAEIYKGLFKAELFNGKVLKQLGTVTTTEH
ENALLRSFDKETTYFSGFYENRKNVFSAEDISTAIPHRIVQDNFPKFKENCHIFTRLITAVPSLREHFENVKKAIGI
FVSTSIEEVFSFPPFYNQLLTQTQIDLYNQLLGGISREAGTEKIKGLNEVLNLAIQKNDETAHIIASLPHRFIPLFKQ
ILSDRNTLSFILEEFKSDEEVIQSFCKYKTLLRNENVLETAEALFNELNSIDLTHIFISHKKLETISSALCDHWDTL
RNALYERRISELTGKITKSAKEKVQRSLKHEDINLQEIISAAGKELSEAFKQKTSEILSHAHAALDQPLPTTLKKQE
EKEILKSQLDSLLGLYHLLDFAVDESNEVDPEFSARLTGIKLEMEPSLSFYNKARNYATKKPYSVEKFKLNFQMPT
LASGWDVNKEKNNGAILFVKNGLYYLGIMPKQKGRYKALSFEPTEKTSEGFDKMYYDYFPDAAKMIPKCSTQLKAVT
AHFQTHTTPILLSNNFIEPLEITKEIYDLNNPEKEPKKFQTAYAKKTGDQKGYREALCKWIDFTRDFPLSKYTKTTSI
DLSSLRPSSQYKDLGEYYAELNPLLYHISFQRIAEKEIMDAVETGKLYLFQIYNKDFAKGHHGKPNLHTLYWTGLFS
PENLAKTSIKLNGQAELFYRPKSRMKRMAHRLGEKMLNKKLKDQKTPIPDTLYQELYDYVNHRLSHDLSDEARALLP
NVITKEVSHEIIKDRRFTSDKFFFHVPITLNYQAANSPSKFNQRVNAYLKEHPETPIIGIDRGERNLIYITVIDSTG
KILEQRSLNTIQQFDYQKKLDNREKERVAARQAWSVVGTIKDLKQGYLSQVIHEIVDLMIHYQAVVVLENLNFGFKS
KRTGIAEKAVYQQFEKMLIDKLNCLVLKDYPAEKVGGVLNPYQLTDQFTSFAKMGTQSGFLFYVPAPYTSKIDPLTG
FVDPFVWKTIKNHESRKHFLEGFDFLHYDVKTGDFILHFKMNRNLSFQRGLPGFMPAWDIVFEKNETQFDAKGTPFI
AGKRIVPVIENHRFTGRYRDLYPANELIALLEEKGIVFRDGSNILPKLLENDDSHAIDTMVALIRSVLQMRNSNAAT
GEDYINSPVRDLNGVCFDSRFQNPEWPMDADANGAYHIALKGQLLLNHLKESKDLKLQNGISNQDWLAYIQELRN
XPMVSKGEELFTGVVPILVELDGDVMGHKFSVSGEGEGDATYGKLTLKFICTTGKIPVPWPTLVTTLTYGVQCFSR
YPDHMKQHDFFFKSAMPEGYVQERTIFFKDDGNYKTRAEVKFEGDTLVNRIELKGIDFKEDGNILGHKLEYNYNSHN
VYIMADKQKNGIKVNFKIRHNIEDGSVQLADHYQQNTPIGDGPVLLPDNHYLSTQSALSKDPNEKRDHMVLLEFVT
AAGITLGMDELYK

SEQ ID NO: 126
MTQFEGFTNLYQVSKTLRFELIPQGKTLKHIQEQGFIEEDKARNDHYKELKPIIDRIYKTYADQCLQLVQLDWENLS
AAIDSYRKEKTEETRNALIEEQATYRNAIHDYFIGRTDNLTDAINKRHAEIYKGLFKAELFNGKVLKQLGTVTTTEH
ENALLRSFDKETTYFSGFYENRKNVFSAEDISTAIPHRIVQDNFPKFKENCHIFTRLITAVPSLREHFENVKKAIGI
FVSTSIEEVFSFPPFYNQLLTQTQIDLYNQLLGGISREAGTEKIKGLNEVLNLAIQKNDETAHIIASLPHRFIPLFKQ
ILSDRNTLSFILEEFKSDEEVIQSFCKYKTLLRNENVLETAEALFNELNSIDLTHIFISHKKLETISSALCDHWDTL
RNALYERRISELTGKITKSAKEKVQRSLKHEDINLQEIISAAGKELSEAFKQKTSEILSHAHAALDQPLPTTLKKQE
EKEILKSQLDSLLGLYHLLDWFAVDESNEVDPEFSARLTGIKLEMEPSLSFYNKARNYATKKPYSVEKFKLNFQMPT
LASGWDVNKEKNNGAILFVKNGLYYLGIMPKQKGRYKALSFEPTEKTSEGFDKMYYDYFPDAAKMIPKCSTQLKAVT
AHFQTHTTPILLSNNFIEPLEITKEIYDLNNPEKEPKKFQTAYAKKTGDQKGYREALCKWIDFTRDFPLSKYTKTTSI
DLSSLRPSSQYKDLGEYYAELNPLLYHISFQRIAEKEIMDAVETGKLYLFQIYNKDFAKGHHGKPNLHTLYWTGLFS
PENLAKTSIKLNGQAELFYRPKSRMKRMAHRLGEKMLNKKLKDQKTPIPDTLYQELYDYVNHRLSHDLSDEARALLP
NVITKEVSHEIIKDRRFTSDKFFFHVPITLNYQAANSPSKFNQRVNAYLKEHPETPIIGIDRGERNLIYITVIDSTG
KILEQRSLNTIQQFDYQKKLDNREKERVAARQAWSVVGTIKDLKQGYLSQVIHEIVDLMIHYQAVVVLENLNFGFKS
KRTGIAEKAVYQQFEKMLIDKLNCLVLKDYPAEKVGGVLNPYQLTDQFTSFAKMGTQSGFLFYVPAPYTSKIDPLTG
FVDPFVWKTIKNHESRKHFLEGFDFLHYDVKTGDFILHFKMNRNLSFQRGLPGFMPAWDIVFEKNETQFDAKGTPFI
AGKRIVPVIENHRFTGRYRDLYPANELIALLEEKGIVFRDGSNILPKLLENDDSHAIDTMVALIRSVLQMRNSNAAT
GEDYINSPVRDLNGVCFDSRFQNPEWPMDADANGAYHIALKGQLLLNHLKESKDLKLQNGISNQDWLAYIQELRN
XPXPMVSKGEELFTGVVPILVELDGDVNGHKFSVSGEGEGDATYGKLTLKFICTTGKLPVPWPTLVTTLTYGVQCF
SRYPDHMKQHDFFFKSAMPEGYVQERTIFFKDDGNYKTRAEVKFEGDTLVNRIELKGIFKEDGNILGHKLEYNYNS
HNVYIMADKQKNGIKVNFKIRHNIEDGSVQLADHYQQNTPIGDGPVLLPDNHYLSTQSALSKDPNEKRDHMVLLEF
VTAAGITLGMDELYK

SEQ ID NO: 127
MTQFEGFTNLYQVSKTLRFELIPQGKTLKHIQEQGFIEEDKARNDHYKELKPIIDRIYKTYADQCLQLVQLDWENLS
AAIDSYRKEKTEETRNALIEEQATYRNAIHDYFIGRTDNLTDAINKRHAEIYKGLFKAELFNGKVLKQLGTVTTTEH
ENALLRSFDKETTYFSGFYENRKNVFSAEDISTAIPHRIVQDNFPKFKENCHIFTRLITAVPSLREHFENVKKAIGI
FVSTSIEEVFSFPPFYNQLLTQTQIDLYNQLLGGISREAGTEKIKGLNEVLNLAIQKNDETAHIIASLPHRFIPLFKQ
ILSDRNTLSFILEEFKSDEEVIQSFCKYKTLLRNENVLETAEALFNELNSIDLTHIFISHKKLETISSALCDHWDTL
RNALYERRISELTGKITKSAKEKVQRSLKHEDINLQEIISAAGKELSEAFKQKTSEILSHAHAALDQPLPTTLKKQE
EKEILKSQLDSLLGLYHLLDWFAVDESNEVDPEFSARLTGIKLEMEPSLSFYNKARNYATKKPYSVEKFKLNFQMPT
LASGWDVNKEKNNGAILFVKNGLYYLGIMPKQKGRYKALSFEPTEKTSEGFDKMYYDYFPDAAKMIPKCSTQLKAVT
AHFQTHTTPILLSNNFIEPLEITKEIYDLNNPEKEPKKFQTAYAKKTGDQKGYREALCKWIDFTRDFPLSKYTKTTSI
DLSSLRPSSQYKDLGEYYAELNPLLYHISFQRIAEKEIMDAVETGKLYLFQIYNKDFAKGHHGKPNLHTLYWTGLFS
PENLAKTSIKLNGQAELFYRPKSRMKRMAHRLGEKMLNKKLKDQKTPIPDTLYQELYDYVNHRLSHDLSDEARALLP
NVITKEVSHEIIKDRRFTSDKFFFHVPITLNYQAANSPSKFNQRVNAYLKEHPETPIIGIDRGERNLIYITVIDSTG
KILEQRSLNTIQQFDYQKKLDNREKERVAARQAWSVVGTIKDLKQGYLSQVIHEIVDLMIHYQAVVVLENLNFGFKS
KRTGIAEKAVYQQFEKMLIDKLNCLVLKDYPAEKVGGVLNPYQLTDQFTSFAKMGTQSGFLFYVPAPYTSKIDPLTG
FVDPFVWKTIKNHESRKHFLEGFDFLHYDVKTGDFILHFKMNRNLSFQRGLPGFMPAWDIVFEKNETQFDAKGTPFI
AGKRIVPVIENHRFTGRYRDLYPANELIALLEEKGIVFRDGSNILPKLLENDDSHAIDTMVALIRSVLQMRNSNAAT
```

TABLE V.3-continued

AsCas12a-Linker-eGFP Chimeras

GEDYINSPVRDLNGVCFDSRFQNPEWPMDADANGAYHIALKGQLLLNHLKESKDLKLQNGISNQDWLAYIQELRN
XPXPXP*MVSKGEELFTGVVPILVELDGDVNGHKFSVSGEGEGDATYGKLTLKFICTTGKLPVPWPTLVTTLTYGVQ*
*CFSRYPDHMKQHDFFFKSAMPEGYVQERTIFFKDDGNYKTRAEVKFEGDTLVN*
*RIELKGIDFKEDGNILGHKLEYNYNSHNVYIMADKQKNGIKVNFKIRHNIEDGSVQLADHYQQNTPIGDGPVLLPDNHYLS*
*TQSALSKDPNEKRDHMVLLEFVTAAGITLGMDELYK*

SEQ ID NO: 128
MTQFEGFTNLYQVSKTLRFELIPQGKTLKHIQEQGFIEEDKARNDHYKELKPIIDRIYKTYADQCLQLVQLDWENLS
AAIDSYRKEKTEETRNALIEEQATYRNAIHDYFIGRTDNLTDAINKRHAEIYKGLFKAELFNGKVLKQLGTVTTTEH
ENALLRSFDKFTTYFSGFYENRKNVFSAEDISTAIPHRIVQDNFPKFKENCHIFTRLITAVPSLREHFENVKKAIGI
FVSTSIEEVFSPFYNQLLTQTQIDLYNQLLGGISREAGTEKIKGLNEVLNLAIQKNDETAHIIASLPHRFIPLFKQ
ILSDRNTLSFILEEFKSDEEVIQSFCKYKTLLRNENVLETAEALFNELNSIDLTHIFISHKKLETISSALCDHWDTL
RNALYERRISELTGKITKSAKEKVQRSLKHEDINLQEIISAAGKELSEAFKQKTSEILSHAHAALDQPLPTTLKKQE
EKEILKSQLDSLLGLYHLLDWFAVDESNEVDPEFSARLTGIKLEMEPSLSFYNKARNYATKKPYSVEKFKLNFQMPT
LASGWDVNKEKNNGAILFVKNGLYYLGIMPKQKGRYKALSFEPTEKTSEGFDKMYYDYFPDAAKMIPKCSTQLKAVT
AHFQTHTTPILLSNNFIEPLEITKEIYDLNNPEKEPKKFQTAYAKKTGDQKGYREALCKWIDFTRDFLSKYTKTTSI
DLSSLRPSSQYKDLGEYYAELNPLLYHISFQRIAEKEIMDAVETGKLYLFQIYNKDFAKGHHGKPNLHTLYWTGLFS
PENLAKTSIKLNGQAELFYRPKSRMKRMAHRLGEKMLNKKLKDQKTPIPDTLYQELYDYVNHRLSHDLSDEARALLP
NVITKEVSHEIIKDRRFTSDKFFFHVPITLNYQAANSPSKFNQRVNAYLKEHPETPIIGIDRGERNLIYITVIDSTG
KILEQRSLNTIQQFDYQKKLDNREKERVAARQAWSVVGTIKDLKQGYLSQVIHEIVDLMIHYQAVVVLENLNFGFKS
KRTGIAEKAVYQQFEKMLIDKLNCLVLKDYPAEKVGGVLNPYQLTDQFTSFAKMGTQSGFLFYVPAPYTSKIDPLTG
FVDPFVWKTIKNHESRKHFLEGFDFLHYDVKTGDFILHFKMNRNLSFQRGLPGFMPAWDIVFEKNETQFDAKGTPFI
AGKRIVPVIENHRFTGRYRDLYPANELIALLEEKGIVFRDGSNILPKLLENDDSHAIDTMVALIRSVLQMRNSNAAT
GEDYINSPVRDLNGVCFDSRFQNPEWPMDADANGAYHIALKGQLLLNHLKESKDLKLQNGISNQDWLAYIQELRN
XPXPXPXP*MVSKGEELFTGVVPILVELDGDVNGHKFSVSGEGEGDATYGKLTLKFICTTGKLPVPWPTLVTTLTYG*
*VQCFSRYPDHMKQHDFFFKSAMPEGYVQERTIFFKDDGNYKTRAEVKFEGDTLVNRIELKGIDFKEDGNILGHKLEY*
*NYNSHNVYIMADKQKNGIKVNFKIRHNIEDGSVQLADHYQQNTPIGDGPVLLPDNHYLSTQSALSKDPNEKRDHMV*
*LLEFVTAAGITLGMDELYK*

SEQ ID NO: 129
MTQFEGFTNLYQVSKTLRFELIPQGKTLKHIQEQGFIEEDKARNDHYKELKPIIDRIYKTYADQCLQLVQLDWENLS
AAIDSYRKEKTEETRNALIEEQATYRNAIHDYFIGRTDNLTDAINKRHAEIYKGLFKAELFNGKVLKQLGTVTTTEH
ENALLRSFDKFTTYFSGFYENRKNVFSAEDISTAIPHRIVQDNFPKFKENCHIFTRLITAVPSLREHFENVKKAIGI
FVSTSIEEVFSPFYNQLLTQTQIDLYNQLLGGISREAGTEKIKGLNEVLNLAIQKNDETAHIIASLPHRFIPLFKQ
ILSDRNTLSFILEEFKSDEEVIQSFCKYKTLLRNENVLETAEALFNELNSIDLTHIFISHKKLETISSALCDHWDTL
RNALYERRISELTGKITKSAKEKVQRSLKHEDINLQEIISAAGKELSEAFKQKTSEILSHAHAALDQPLPTTLKKQE
EKEILKSQLDSLLGLYHLLDWFAVDESNEVDPEFSARLTGIKLEMEPSLSFYNKARNYATKKPYSVEKFKLNFQMPT
LASGWDVNKEKNNGAILFVKNGLYYLGIMPKQKGRYKALSFEPTEKTSEGFDKMYYDYFPDAAKMIPKCSTQLKAVT
AHFQTHTTPILLSNNFIEPLEITKEIYDLNNPEKEPKKFQTAYAKKTGDQKGYREALCKWIDFTRDFLSKYTKTTSI
DLSSLRPSSQYKDLGEYYAELNPLLYHISFQRIAEKEIMDAVETGKLYLFQIYNKDFAKGHHGKPNLHTLYWTGLFS
PENLAKTSIKLNGQAELFYRPKSRMKRMAHRLGEKMLNKKLKDQKTPIPDTLYQELYDYVNHRLSHDLSDEARALLP
NVITKEVSHEIIKDRRFTSDKFFFHVPITLNYQAANSPSKFNQRVNAYLKEHPETPIIGIDRGERNLIYITVIDSTG
KILEQRSLNTIQQFDYQKKLDNREKERVAARQAWSVVGTIKDLKQGYLSQVIHEIVDLMIHYQAVVVLENLNFGFKS
KRTGIAEKAVYQQFEKMLIDKLNCLVLKDYPAEKVGGVLNPYQLTDQFTSFAKMGTQSGFLFYVPAPYTSKIDPLTG
FVDPFVWKTIKNHESRKHFLEGFDFLHYDVKTGDFILHFKMNRNLSFQRGLPGFMPAWDIVFEKNETQFDAKGTPFI
AGKRIVPVIENHRFTGRYRDLYPANELIALLEEKGIVFRDGSNILPKLLENDDSHAIDTMVALIRSVLQMRNSNAAT
GEDYINSPVRDLNGVCFDSRFQNPEWPMDADANGAYHIALKGQLLLNHLKESKDLKLQNGISNQDWLAYIQELRN
XPXPXPXPXP*MVSKGEELFTGVVPILVELDGDVNGHKFSVSGEGEGDATYGKLTL*
*KFICTTGKLPVPWPTLVTTLTYGVQCFSRYPDHMKQHDFFFKSAMPEGYVQE*
*RTIFFKDDGNYKTRAEVKFEGDTLVNRIELKGIDFKEDGNILGHKIEYNYNSHNVYIMADKQKNGIKVNFKIRHN*
*NHYLSTQSALSKDPNEKRDHIEDGSVQLADHYQQNTPIGDGPVLLPDMVLLEFVTAAGITLGMDELYK*

SEQ ID NO: 130
MTQFEGFTNLYQVSKTLRFELIPQGKTLKHIQEQGFIEEDKARNDHYKELKPIIDRIYKTYADQCLQLVQLDWENLS
AAIDSYRKEKTEETRNALIEEQATYRNAIHDYFIGRTDNLTDAINKRHAEIYKGLFKAELFNGKVLKQLGTVTTTEH
ENALLRSFDKFTTYFSGFYENRKNVFSAEDISTAIPHRIVQDNFPKFKENCHIFTRLITAVPSLREHFENVKKAIGI
FVSTSIEEVFSPFYNQLLTQTQIDLYNQLLGGISREAGTEKIKGLNEVLNLAIQKNDETAHIIASLPHRFIPLFKQ
ILSDRNTLSFILEEFKSDEEVIQSFCKYKTLLRNENVLETAEALFNELNSIDLTHIFISHKKLETISSALCDHWDTL
RNALYERRISELTGKITKSAKEKVQRSLKHEDINLQEIISAAGKELSEAFKQKTSEILSHAHAALDQPLPTTLKKQE
EKEILKSQLDSLLGLYHLLDWFAVDESNEVDPEFSARLTGIKLEMEPSLSFYNKARNYATKKPYSVEKFKLNFQMPT
LASGWDVNKEKNNGAILFVKNGLYYLGIMPKQKGRYKALSFEPTEKTSEGFDKMYYDYFPDAAKMIPKCSTQLKAVT
AHFQTHTTPILLSNNFIEPLEITKEIYDLNNPEKEPKKFQTAYAKKTGDQKGYREALCKWIDFTRDFLSKYTKTTSI
DLSSLRPSSQYKDLGEYYAELNPLLYHISFQRIAEKEIMDAVETGKLYLFQIYNKDFAKGHHGKPNLHTLYWTGLFS
PENLAKTSIKLNGQAELFYRPKSRMKRMAHRLGEKMLNKKLKDQKTPIPDTLYQELYDYVNHRLSHDLSDEARALLP
NVITKEVSHEIIKDRRFTSDKFFFHVPITLNYQAANSPSKFNQRVNAYLKEHPETPIIGIDRGERNLIYITVIDSTG
KILEQRSLNTIQQFDYQKKLDNREKERVAARQAWSVVGTIKDLKQGYLSQVIHEIVDLMIHYQAVVVLENLNFGFKS
KRTGIAEKAVYQQFEKMLIDKLNCLVLKDYPAEKVGGVLNPYQLTDQFTSFAKMGTQSGFLFYVPAPYTSKIDPLTG
FVDPFVWKTIKNHESRKHFLEGFDFLHYDVKTGDFILHFKMNRNLSFQRGLPGFMPAWDIVFEKNETQFDAKGTPFI
AGKRIVPVIENHRFTGRYRDLYPANELIALLEEKGIVFRDGSNILPKLLENDDSHAIDTMVALIRSVLQMRNSNAAT
GEDYINSPVRDLNGVCFDSRFQNPEWPMDADANGAYHIALKGQLLLNHLKESKDLKLQNGISNQDWLAYIQELRN
XPXPXPXPXPXP*MVSKGEELFTGVVPILVELDGDVNGHKFSVSGEGEGDATYGKLTLKFICTTGKLPVPWPTLVTT*
*LTYGVQCFSRYPDHMKQHDFFFKSAMPEEGYVQERTIFFKDDGNYKTRAEVKFEGDTLVNRIELKGIDFKEDGNILGH*
*KLEYNYNSHNVYIMADKQKNGIKVNFKIRHNIEDGSVQLADHYQQNTPIGDGPVLLEDNHYLSTQSALSKDPNEKR*
*DHMVLLEFVTAAGITLGMDELYK*

SEQ ID NO: 131
MTQFEGFTNLYQVSKTLRFELIPQGKTLKHIQEQGFIEEDKARNDHYKELKPIIDRIYKTYADQCLQLVQLDWENLS
AAIDSYRKEKTEETRNALIEEQATYRNAIHDYFIGRTDNLTDAINKRHAEIYKGLFKAELFNGKVLKQLGTVTTTEH

TABLE V.3-continued

AsCas12a-Linker-eGFP Chimeras

```
ENALLRSFDKFTTYFSGFYENRKNVFSAEDISTAIPHRIVQDNFPKFKENCHIFTRLITAVPSLREHFENVKKAIGI
FVSTSIEEVFSPPFYNQLLTQTQIDLYNQLLGGISREAGTEKIKGLNEVLNLAIQKNDETAHIIASLPHRFIPLFKQ
ILSDRNTLSFILEEFKSDEEVIQSFCKYKTLLRNENVLETAEALFNELNSIDLTHIFISHKKLETISSALCDHWDTL
RNALYERRISELTGKITKSAKEKVQRSLKHEDINLQEIISAAGKELSEAFKQKTSEILSHAHAALDQPLPTTLKKQE
EKEILKSQLDSLLGLYHLLDWFAVDESNEVDPEFSARLTGIKLEMEPSLSFYNKARNYATKKPYSVEKFKLNFQMPT
LASGWDVNKEKNNGAILFVKNGLYYLGIMPKQKGRYKALSFEPTEKTSEGFDKMYYDYFPDAAKMIPKCSTQLKAVT
AHFQTHTTPILLSNNFIEPLEITKEIYDLNNPEKEPKKFQTAYAKKTGDQKGYREALCKWIDFTRDFLSKYTKTTSI
DLSSLRPSSQYKDLGEYYAELNPLLYHISFQRIAEKEIMDAVETGKLYLFQIYNKDFAKGHHGKPNLHTLYWTGLFS
PENLAKTSIKLNGQAELFYRPKSRMKRMAHRLGEKMLNKKLKDQKTPIPDTLYQELYDYVNHRLSHDLSDEARALLP
NVITKEVSHEIIKDRRFTSDKFFFHVPITLNYQAANSPSKFNQRVNAYLKEHPETPIIGIDRGERNLIYITVIDSTG
KILEQRSLNTIQQFDYQKKLDNREKERVAARQAWSVVGTIKDLKQGYLSQVIHEIVDLMIHYQAVVVLENLNFGFKS
KRTGIAEKAVYQQFEKMLIDKLNCLVLKDYPAEKVGGVLNPYQLTDQFTSFAKMGTQSGFLFYVPAPYTSKIDPLTG
FVDPFVWKTIKNHESRKHFLEGFDFLHYDVKTGDFILHFKMNRNLSFQRGLPGFMPAWDIVFEKNETQFDAKGTPFI
AGKRIVPVIENHRFTGRYRDLYPANELIALLEEKGIVFRDGSNILPKLLENDDSHAIDTMVALIRSVLQMRNSNAAT
GEDYINSPVRDLNGVCFDSRFQNPEWPMDADANGAYHIALKGQLLLNHLKESKDLKLQNGISNQDWLAYIQELRN
XPXPXPXPXPXPXPXP*MVSKGEELFTGVVPILVELDGDVNGHKFSVSGEGEGDATYGKLTLKFICTTGKLPVPWPTLV
TTLTYGVQCFSRYPDHMKQHDFFKSAMPEGYVQERTIFFKDDGNYKTRAEVKFEGDTLVNRIELKGIDFKEDGNIL
GHKLEYNYNSHNVYIMADKQKNGIKVNFKIRHNIEDGSVQLADHYQQNTPIGDGPVLLPDNHYLSTQSALSKDPNE
KRDHMVLLEFVTAAGITLGMDELYK*

SEQ ID NO: 132
MTQFEGFTNLYQVSKTLRFELIPQGKTLKHIQEQGFIEEDKARNDHYKELKPIIDRIYKTYADQCLQLVQLDWENLS
AAIDSYRKEKTEETRNALIEEQATYRNAIHDYFIGRTDNLTDAINKRHAEIYKGLFKAELFNGKVLKQLGTVTTTEH
ENALLRSFDKFTTYFSGFYENRKNVFSAEDISTAIPHRIVQDNFPKFKENCHIFTRLITAVPSLREHFENVKKAIGI
FVSTSIEEVFSPPFYNQLLTQTQIDLYNQLLGGISREAGTEKIKGLNEVLNLAIQKNDETAHIIASLPHRFIPLFKQ
ILSDRNTLSFILEEFKSDEEVIQSFCKYKTLLRNENVLETAEALFNELNSIDLTHIFISHKKLETISSALCDHWDTL
RNALYERRISELTGKITKSAKEKVQRSLKHEDINLQEIISAAGKELSEAFKQKTSEILSHAHAALDQPLPTTLKKQE
EKEILKSQLDSLLGLYHLLDWFAVDESNEVDPEFSARLTGIKLEMEPSLSFYNKARNYATKKPYSVEKFKLNFQMPT
LASGWDVNKEKNNGAILFVKNGLYYLGIMPKQKGRYKALSFEPTEKTSEGFDKMYYDYFPDAAKMIPKCSTQLKAVT
AHFQTHTTPILLSNNFIEPLEITKEIYDLNNPEKEPKKFQTAYAKKTGDQKGYREALCKWIDFTRDFLSKYTKTTSI
DLSSLRPSSQYKDLGEYYAELNPLLYHISFQRIAEKEIMDAVETGKLYLFQIYNKDFAKGHHGKPNLHTLYWTGLFS
PENLAKTSIKLNGQAELFYRPKSRMKRMAHRLGEKMLNKKLKDQKTPIPDTLYQELYDYVNHRLSHDLSDEARALLP
NVITKEVSHEIIKDRRFTSDKFFFHVPITLNYQAANSPSKFNQRVNAYLKEHPETPIIGIDRGERNLIYITVIDSTG
KILEQRSLNTIQQFDYQKKLDNREKERVAARQAWSVVGTIKDLKQGYLSQVIHEIVDLMIHYQAVVVLENLNFGFKS
KRTGIAEKAVYQQFEKMLIDKLNCLVLKDYPAEKVGGVLNPYQLTDQFTSFAKMGTQSGFLFYVPAPYTSKIDPLTG
FVDPFVWKTIKNHESRKHFLEGFDFLHYDVKTGDFILHFKMNRNLSFQRGLPGFMPAWDIVFEKNETQFDAKGTPFI
AGKRIVPVIENHRFTGRYRDLYPANELIALLEEKGIVFRDGSNILPKLLENDDSHAIDTMVALIRSVLQMRNSNAAT
GEDYINSPVRDLNGVCFDSRFQNPEWPMDADANGAYHIALKGQLLLNHLKESKDLKLQNGISNQDWLAYIQELRN
XPXPXPXPXPXPXPXP*MVSKGEELFTGVVPILVELDGDVNGHKFSVSGEGEGDATYGKLTLKFICTTGKLPVPWPT
LVTTLTYGVQCFSRYPDHMKQHDFFKSAMPEGYVQERTIFFKDDGNYKTRAEVKFEGDTLVNRIELKGIDFKEDGN
ILGHKLEYNYNSHNVYIMADKQKNGIKVNFKIRHNIEDGSVQLADHYQQNTPIGDGPVLLPDNHYLSTQSALSKDP
NEKRDHMVLLEFVTAAGITLGMDELYK*

SEQ ID NO: 133
MTQFEGFTNLYQVSKTLRFELIPQGKTLKHIQEQGFIEEDKARNDHYKELKPIIDRIYKTYADQCLQLVQLDWENLS
AAIDSYRKEKTEETRNALIEEQATYRNAIHDYFIGRTDNLTDAINKRHAEIYKGLFKAELFNGKVLKQLGTVTTTEH
ENALLRSFDKFTTYFSGFYENRKNVFSAEDISTAIPHRIVQDNFPKFKENCHIFTRLITAVPSLREHFENVKKAIGI
FVSTSIEEVFSPPFYNQLLTQTQIDLYNQLLGGISREAGTEKIKGLNEVLNLAIQKNDETAHIIASLPHRFIPLFKQ
ILSDRNTLSFILEEFKSDEEVIQSFCKYKTLLRNENVLETAEALFNELNSIDLTHIFISHKKLETISSALCDHWDTL
RNALYERRISELTGKITKSAKEKVQRSLKHEDINLQEIISAAGKELSEAFKQKTSEILSHAHAALDQPLPTTLKKQE
EKEILKSQLDSLLGLYHLLDWFAVDESNEVDPEFSARLTGIKLEMEPSLSFYNKARNYATKKPYSVEKFKLNFQMPT
LASGWDVNKEKNNGAILFVKNGLYYLGIMPKQKGRYKALSFEPTEKTSEGFDKMYYDYFPDAAKMIPKCSTQLKAVT
AHFQTHTTPILLSNNFIEPLEITKEIYDLNNPEKEPKKFQTAYAKKTGDQKGYREALCKWIDFTRDFLSKYTKTTSI
DLSSLRPSSQYKDLGEYYAELNPLLYHISFQRIAEKEIMDAVETGKLYLFQIYNKDFAKGHHGKPNLHTLYWTGLFS
PENLAKTSIKLNGQAELFYRPKSRMKRMAHRLGEKMLNKKLKDQKTPIPDTLYQELYDYVNHRLSHDLSDEARALLP
NVITKEVSHEIIKDRRFTSDKFFFHVPITLNYQAANSPSKFNQRVNAYLKEHPETPIIGIDRGERNLIYITVIDSTG
KILEQRSLNTIQQFDYQKKLDNREKERVAARQAWSVVGTIKDLKQGYLSQVIHEIVDLMIHYQAVVVLENLNFGFKS
KRTGIAEKAVYQQFEKMLIDKLNCLVLKDYPAEKVGGVLNPYQLTDQFTSFAKMGTQSGFLFYVPAPYTSKIDPLTG
FVDPFVWKTIKNHESRKHFLEGFDFLHYDVKTGDFILHFKMNRNLSFQRGLPGFMPAWDIVFEKNETQFDAKGTPFI
AGKRIVPVIENHRFTGRYRDLYPANELIALLEEKGIVFRDGSNILPKLLENDDSHAIDTMVALIRSVLQMRNSNAAT
GEDYINSPVRDLNGVCFDSRFQNPEWPMDADANGAYHIALKGQLLLNHLKESKDLKLQNGISNQDWLAYIQELRN
XPXPXPXPXPXPXPXP*MVSKGEELFTGVVPILVELDGDVNGHKFSVSGEGEGDATYGKLTLKFICTTGKLPVPW
PTLVTTLTYGVQCFSRYPDHMKQHDFFKSAMPEGYVQERTIFFKDDGNYKTRAEVKFEGDTLVNRIELKGIDFKED
GNILGHKLEYNYNSHNVYIMADKQKNGIKVNFKIRHNIEDGSVQLADHYQQNTPIGDGPVLLPDNHYLSTQSALSK
DPNEKRDHMVLLEFVTAAGITLGMDELYK*

SEQ ID NO: 134
MTQFEGFTNLYQVSKTLRFELIPQGKTLKHIQEQGFIEEDKARNDHYKELKPIIDRIYKTYADQCLQLVQLDWENLS
AAIDSYRKEKTEETRNALIEEQATYRNAIHDYFIGRTDNLTDAINKRHAEIYKGLFKAELFNGKVLKQLGTVTTTEH
ENALLRSFDKFTTYFSGFYENRKNVFSAEDISTAIPHRIVQDNFPKFKENCHIFTRLITAVPSLREHFENVKKAIGI
FVSTSIEEVFSPPFYNQLLTQTQIDLYNQLLGGISREAGTEKIKGLNEVLNLAIQKNDETAHIIASLPHRFIPLFKQ
ILSDRNTLSFILEEFKSDEEVIQSFCKYKTLLRNENVLETAEALFNELNSIDLTHIFISHKKLETISSALCDHWDTL
RNALYERRISELTGKITKSAKEKVQRSLKHEDINLQEIISAAGKELSEAFKQKTSEILSHAHAALDQPLPTTLKKQE
EKEILKSQLDSLLGLYHLLDWFAVDESNEVDPEFSARLTGIKLEMEPSLSFYNKARNYATKKPYSVEKFKLNFQMPT
LASGWDVNKEKNNGAILFVKNGLYYLGIMPKQKGRYKALSFEPTEKTSEGFDKMYYDYFPDAAKMIPKCSTQLKAVT
AHFQTHTTPILLSNNFIEPLEITKEIYDLNNPEKEPKKFQTAYAKKTGDQKGYREALCKWIDFTRDFLSKYTKTTSI
DLSSLRPSSQYKDLGEYYAELNPLLYHISFQRIAEKEIMDAVETGKLYLFQIYNKDFAKGHHGKPNLHTLYWTGLFS
PENLAKTSIKLNGQAELFYRPKSRMKRMAHRLGEKMLNKKLKDQKTPIPDTLYQELYDYVNHRLSHDLSDEARALLP
```

TABLE V.3-continued

AsCas12a-Linker-eGFP Chimeras

NVITKEVSHEIIKDRRFTSDKFFFHVPITLNYQAANSPSKFNQRVNAYLKEHPETPIIGIDRGERNLIYITVIDSTG
KILEQRSLNTIQQFDYQKKLDNREKERVAARQAWSVVGTIKDLKQGYLSQVIHEIVDLMIHYQAVVVLENLNFGFKS
KRTGIAEKAVYQQFEKMLIDKLNCLVLKDYPAEKVGGVLNPYQLTDQFTSFAKMGTQSGFLFYVPAPYTSKIDPLTG
FVDPFVWKTIKNHESRKHFLEGFDFLHYDVKTGDFILHFKMNRNLSFQRGLPGFMPAWDIVFEKNETQFDAKGTPFI
AGKRIVPVIENHRFTGRYRDLYPANELIALLEEKGIVFRDGSNILPKLLENDDSHAIDTMVALIRSVLQMRNSNAAT
GEDYINSPVRDLNGVCFDSRFQNPEWPMDADANGAYHIALKGQLLLNHLKESKDLKLQNGISNQDWLAYIQELRN
XPXPXPXPXPXPXPXPXPXP*MVSKGEELFTGVVPILVELDGDVNGHKFS*
*VSGEGEGDATYGKLTLKFICTTGKLPVPWPTLVTTLTYGVQCFSRYPDHMKQHDFF*
*KSAMPEGYVQERTIFFKDDGNYKTRAEVKFEGDTLVNRIELKGIDFK*
*EDGNILGHKLEYNYNSHNVYIMADKQKNGIKVNFKIRHNIEDGSVQLADHYQQNT*
*PIGDGPVLLPDNHYLSTQSAISKDPNEKRDHMVLLEFVTAAGITLGMDELYK*

SEQ ID NO: 135
MTQFEGFTNLYQVSKTLRFELIPQGKTLKHIQEQGFIEEDKARNDHYKELKPIIDRIYKTYADQCLQLVQLDWENLS
AAIDSYRKEKTEETRNALIEEQATYRNAIHDYFIGRTDNLTDAINKRHAEIYKGLFKAELFNGKVLKQLGTVTTTEH
ENALLRSFDKETTYFSGFYENRKNVFSAEDISTAIPHRIVQDNFPKFKENCHIFTRLITAVPSLREHFENVKKAIGI
FVSTSIEEVFSPFYNQLLTQTQIDLYNQLLGGISREAGTEKIKGLNEVLNLAIQKNDETAHIIASLPHRFIPLFKQ
ILSDRNTLSFILEEFKSDEEVIQSFCKYKTLLRNENVLETAEALFNELNSIDLTHIFISHKKLETISSALCDHWDTL
RNALYERRISELTGKITKSAKEKVQRSLKHEDINLQEIISAAGKELSEAFKQKTSEILSHAHAALDQPLPTTLKKQE
EKEILKSQLDSLLGLYHLLDWFAVDESNEVDPEFSARLTGIKLEMEPSLSFYNKARNYATKKPYSVEKFKLNFQMPT
LASGWDVNKEKNNGAILFVKNGLYYLGIMPKQKGRYKALSFEPTEKTSEGFDKMYYDYFPDAAKMIPKCSTQLKAVT
AHFQTHTTPILLSNNFIEPLEITKEIYDLNNPEKEPKKFQTAYAKKTGDQKGYREALCKWIDFTRDFLSKYTKTTSI
DLSSLRPSSQYKDLGEYYAELNPLLYHISFQRIAEKEIMDAVETGKLYLFQIYNKDFPAKGHHGKPNLHTLYWTGLFS
PENLAKTSIKLNGQAELFYRPKSRMKRMAHRLGEKMLNKKLKDQKTPIPDTLYQELYDYVNHRLSHDLSDEARALLP
NVITKEVSHEIIKDRRFTSDKFFFHVPITLNYQAANSPSKFNQRVNAYLKEHPETPIIGIDRGERNLIYITVIDSTG
KILEQRSLNTIQQFDYQKKLDNREKERVAARQAWSVVGTIKDLKQGYLSQVIHEIVDLMIHYQAVVVLENLNFGFKS
KRTGIAEKAVYQQFEKMLIDKLNCLVLKDYPAEKVGGVLNPYQLTDQFTSFAKMGTQSGFLFYVPAPYTSKIDPLTG
FVDPFVWKTIKNHESRKHFLEGFDFLHYDVKTGDFILHFKMNRNLSFQRGLPGFMPAWDIVFEKNETQFDAKGTPFI
AGKRIVPVIENHRFTGRYRDLYPANELIALLEEKGIVFRDGSNILPKLLENDDSHAIDTMVALIRSVLQMRNSNAAT
GEDYINSPVRDLNGVCFDSRFQNPEWPMDADANGAYHIALKGQLLLNHLKESKDLKLQNGISNQDWLAYIQELRN
XPXPXPXPXPXPXPXPXPXP*MVSKGEELFTGVVPILVELDGDVNGHKFSVSGEGEGDATYGKLTLKFICTTGKL*
*PVPWPTLVTTLTYGVQCFSRYPDHMKQHDFFKSAMPEGYVQERTIFFKDDGNYKTRAEVKFEGDTLVNRIELKGID*
*FKEDGNILGHKLEYNYNSHNVYIMADKQKNGIKVNFKIRHNIEDGSVQLADHYQQNTPIGDGPVLLPDNHYLSTQS*
*ALSKDPNEKRDHMVLLEFVTAAGITLGMDELYK*

SEQ ID NO: 136
MTQFEGFTNLYQVSKTLRFELIPQGKTLKHIQEQGFIEEDKARNDHYKELKPIIDRIYKTYADQCLQLVQLDWENLS
AAIDSYRKEKTEETRNALIEEQATYRNAIHDYFIGRTDNLTDAINKRHAEIYKGLFKAELFNGKVLKQLGTVTTTEH
ENALLRSFDKETTYFSGFYENRKNVFSAEDISTAIPHRIVQDNFPKFKENCHIFTRLITAVPSLREHFENVKKAIGI
FVSTSIEEVFSPFYNQLLTQTQIDLYNQLLGGISREAGTEKIKGLNEVLNLAIQKNDETAHIIASLPHRFIPLFKQ
ILSDRNTLSFILEEFKSDEEVIQSFCKYKTLLRNENVLETAEALFNELNSIDLTHIFISHKKLETISSALCDHWDTL
RNALYERRISELTGKITKSAKEKVQRSLKHEDINLQEIISAAGKELSEAFKQKTSEILSHAHAALDQPLPTTLKKQE
EKEILKSQLDSLLGLYHLLDWFAVDESNEVDPEFSARLTGIKLEMEPSLSFYNKARNYATKKPYSVEKFKLNFQMPT
LASGWDVNKEKNNGAILFVKNGLYYLGIMPKQKGRYKALSFEPTEKTSEGFDKMYYDYFPDAAKMIPKCSTQLKAVT
AHFQTHTTPILLSNNFIEPLEITKEIYDLNNPEKEPKKFQTAYAKKTGDQKGYREALCKWIDFTRDFLSKYTKTTSI
DLSSLRPSSQYKDLGEYYAELNPLLYHISFQRIAEKEIMDAVETGKLYLFQIYNKDFPAKGHHGKPNLHTLYWTGLFS
PENLAKTSIKLNGQAELFYRPKSRMKRMAHRLGEKMLNKKLKDQKTPIPDTLYQELYDYVNHRLSHDLSDEARALLP
NVITKEVSHEIIKDRRFTSDKFFFHVPITLNYQAANSPSKFNQRVNAYLKEHPETPIIGIDRGERNLIYITVIDSTG
KILEQRSLNTIQQFDYQKKLDNREKERVAARQAWSVVGTIKDLKQGYLSQVIHEIVDLMIHYQAVVVLENLNFGFKS
KRTGIAEKAVYQQFEKMLIDKLNCLVLKDYPAEKVGGVLNPYQLTDQFTSFAKMGTQSGFLFYVPAPYTSKIDPLTG
FVDPFVWKTIKNHESRKHFLEGFDFLHYDVKTGDFILHFKMNRNLSFQRGLPGFMPAWDIVFEKNETQFDAKGTPFI
AGKRIVPVIENHRFTGRYRDLYPANELIALLEEKGIVFRDGSNILPKLLENDDSHAIDTMVALIRSVLQMRNSNAAT
GEDYINSPVRDLNGVCFDSRFQNPEWPMDADANGAYHIALKGQLLLNHLKESKDLKLQNGISNQDWLAYIQELRN
XPXPXPXPXPXPXPXPXPXP*MVSKGEELFTGVVPILVELDGDVNGHKFSVSGEGEGDATYGKLTLKFICTTG*
*KLPVPWPTLVTTLTYGVQCFSRYPDHMKQHDFFKSAMPEGYVQERTIFFKDDGNYKYTRAEVKFEGDTLVNRIELKG*
*IDFKEDGNILGHKLEYNYNSHNVYIMADKQKNGIKVNFKIRHNIEDGSVQLADHYQQNTPIGDGPVLLPDNHYLST*
*QSALSKDPNEKRDHMVLLEFVTAAGITLGMDELYK*

SEQ ID NO: 137
MTQFEGFTNLYQVSKTLRFELIPQGKTLKHIQEQGFIEEDKARNDHYKELKPIIDRIYKTYADQCLQLVQLDWENLS
AAIDSYRKEKTEETRNALIEEQATYRNAIHDYFIGRTDNLTDAINKRHAEIYKGLFKAELFNGKVLKQLGTVTTTEH
ENALLRSFDKETTYFSGFYENRKNVFSAEDISTAIPHRIVQDNFPKFKENCHIFTRLITAVPSLREHFENVKKAIGI
FVSTSIEEVFSPFYNQLLTQTQIDLYNQLLGGISREAGTEKIKGLNEVLNLAIQKNDETAHIIASLPHRFIPLFKQ
ILSDRNTLSFILEEFKSDEEVIQSFCKYKTLLRNENVLETAEALFNELNSIDLTHIFISHKKLETISSALCDHWDTL
RNALYERRISELTGKITKSAKEKVQRSLKHEDINLQEIISAAGKELSEAFKQKTSEILSHAHAALDQPLPTTLKKQE
EKEILKSQLDSLLGLYHLLDWFAVDESNEVDPEFSARLTGIKLEMEPSLSFYNKARNYATKKPYSVEKFKLNFQMPT
LASGWDVNKEKNNGAILFVKNGLYYLGIMPKQKGRYKALSFEPTEKTSEGFDKMYYDYFPDAAKMIPKCSTQLKAVT
AHFQTHTTPILLSNNFIEPLEITKEIYDLNNPEKEPKKFQTAYAKKTGDQKGYREALCKWIDFTRDFLSKYTKTTSI
DLSSLRPSSQYKDLGEYYAELNPLLYHISFQRIAEKEIMDAVETGKLYLFQIYNKDFPAKGHHGKPNLHTLYWTGLFS
PENLAKTSIKLNGQAELFYRPKSRMKRMAHRLGEKMLNKKLKDQKTPIPDTLYQELYDYVNHRLSHDLSDEARALLP
NVITKEVSHEIIKDRRFTSDKFFFHVPITLNYQAANSPSKFNQRVNAYLKEHPETPIIGIDRGERNLIYITVIDSTG
KILEQRSLNTIQQFDYQKKLDNREKERVAARQAWSVVGTIKDLKQGYLSQVIHEIVDLMIHYQAVVVLENLNFGFKS
KRTGIAEKAVYQQFEKMLIDKLNCLVLKDYPAEKVGGVLNPYQLTDQFTSFAKMGTQSGFLFYVPAPYTSKIDPLTG
FVDPFVWKTIKNHESRKHFLEGFDFLHYDVKTGDFILHFKMNRNLSFQRGLPGFMPAWDIVFEKNETQFDAKGTPFI
AGKRIVPVIENHRFTGRYRDLYPANELIALLEEKGIVFRDGSNILPKLLENDDSHAIDTMVALIRSVLQMRNSNAAT
GEDYINSPVRDLNGVCFDSRFQNPEWPMDADANGAYHIALKGQLLLNHLKESKDLKLQNGISNQDWLAYIQELRN
XPXPXPXPXPXPXPXPXPXPXP*MVSKGEELFTGVVPILVELDGDVNGHKFSVSGEGEGDATYGKLTLKFICT*
*TGKLPVPWPTLVTTLTYGVQCFSRYPDHMKQHDFFKSAMPEGYVQERTIFFKDDGNYKTRAEVKFEGDTLVNRIEL*

TABLE V.3-continued

AsCas12a-Linker-eGFP Chimeras

*KGIDFKEDGNILGHKLEYNYNSHNVYIMADKQKNGIKVNFKIRHNIEDGSVQLADHY
KGIDFKEDGNILGHKLEYNYNSHNVYIMADKQKSTQSALSKDPNEKRDHMVLLEFVTAAGITLGMDELYK*

```
SEQ ID NO: 138
MTQFEGFTNLYQVSKTLRFELIPQGKTLKHIQEQGFIEEDKARNDHYKELKPIIDRIYKTYADQCLQLVQLDWENLS
AAIDSYRKEKTEETRNALIEEQATYRNAIHDYFIGRTDNLTDAINKRHAEIYKGLFKAELFNGKVLKQLGTVTTTEH
ENALLRSFDKETTYFSGFYENRKNVFSAEDISTAIPHRIVQDNFPKFKENCHIFTRLITAVPSLREHFENVKKAIGI
FVSTSIEEVFSFPFYNQLLTQTQIDLYNQLLGGISREAGTEKIKGLNEVLNLAIQKNDETAHIIASLPHRFIPLFKQ
ILSDRNTLSFILEEFKSDEEVIQSFCKYKTLLRNENVLETAEALFNELNSIDLTHIFISHKKLETISSALCDHWDTL
RNALYERRISELTGKITKSAKEKVQRSLKHEDINLQEIISAAGKELSEAFKQKTSEILSHAHAALDQPLPTTLKKQE
EKEILKSQLDSLLGLYHLLDWFAVDESNEVDPEFSARLTGIKLEMEPSLSFYNKARNYATKKPYSVEKFKLNFQMPT
LASGWDVNKEKNNGAILFVKNGLYYLGIMPKQKGRYKALSFEPTEKTSEGFDKMYYDYFPDAAKMIPKCSTQLKAVT
AHFQTHTTPILLSNNFIEPLEITKEIYDLNNPEKEPKKFQTAYAKKTGDQKGYREALCKWIDFTRDFLSKYTKTTSI
DLSSLRPSSQYKDLGEYYAELNPLLYHISFQRIAEKEIMDAVETGKLYLFQIYNKDFAKGHHGKPNLHTLYWTGLFS
PENLAKTSIKLNGQAELFYRPKSRMKRMAHRLGEKMLNKKLKDQKTPIPDTLYQELYDYVNHRLSHDLSDEARALLP
NVITKEVSHEIIKDRRFTSDKFFFHVPITLNYQAANSPSKFNQRVNAYLKEHPETPIIGIDRGERNLIYITVIDSTG
KILEQRSLNTIQQFDYQKKLDNREKERVAARQAWSVVGTIKDLKQGYLSQVIHEIVDLMIHYQAVVVLENLNFGFKS
KRTGIAEKAVYQQFEKMLIDKLNCLVLKDYPAEKVGGVLNPYQLTDQFTSFAKMGTQSGFLFYVPAPYTSKIDPLTG
FVDPFVWKTIKNHESRKHFLEGFDFLHYDVKTGDFILHFKMNRNLSFQRGLPGFMPAWDIVFEKNETQFDAKGTPFI
AGKRIVPVIENHRFTGRYRDLYPANELIALLEEKGIVFRDGSNILPKLLENDDSHAIDTMVALIRSVLQMRNSNAAT
GEDYINSPVRDLNGVCFDSRFQNPEWPMDADANGAYHIALKGQLLLNHLKESKDLKLQNGISNQDWLAYIQELRN
XPXPXPXPXPXPXPXPXPXPXPXPXP*MVSKGEELFTGVVPILVELDGDVNGHKFSVSGEGEGDATYGKLTLKFI
CTTGKLPVPWPTKVTTKTYGVQCFSRYPDHMKQHDFFKSAMPEGYVQERTIFFKDDGN
YKTRAEVKFEGDTLVNRIELKGIDFKEDGNILGHKLEYNYNSHNVYIM
ADKQKNGIKVNFKIRHNIEDGSVQLADHYQQNTPIGDGPVLLPDNH
YLSTQSALSKDPNEKRDHMVLLEFVTAAGITLGMDELYK*
```

```
SEQ ID NO: 139
MTQFEGFTNLYQVSKTLRFELIPQGKTLKHIQEQGFIEEDKARNDHYKELKPIIDRIYKTYADQCLQLVQLDWENLS
AAIDSYRKEKTEETRNALIEEQATYRNAIHDYFIGRTDNLTDAINKRHAEIYKGLFKAELFNGKVLKQLGTVTTTEH
ENALLRSFDKFTTYFSGFYENRKNVFSAEDISTAIPHRIVQDNFPKFKENCHIFTRLITAVPSLREHFENVKKAIGI
FVSTSIEEVFSFPFYNQLLTQTQIDLYNQLLGGISREAGTEKIKGLNEVLNLAIQKNDETAHIIASLPHRFIPLFKQ
ILSDRNTLSFILEEFKSDEEVIQSFCKYKTLLRNENVLETAEALFNELNSIDLTHIFISHKKLETISSALCDHWDTL
RNALYERRISELTGKITKSAKEKVQRSLKHEDINLQEIISAAGKELSEAFKQKTSEILSHAHAALDQPLPTTLKKQE
EKEILKSQLDSLLGLYHLLDWFAVDESNEVDPEFSARLTGIKLEMEPSLSFYNKARNYATKKPYSVEKFKLNFQMPT
LASGWDVNKEKNNGAILFVKNGLYYLGIMPKQKGRYKALSFEPTEKTSEGFDKMYYDYFPDAAKMIPKCSTQLKAVT
AHFQTHTTPILLSNNFIEPLEITKEIYDLNNPEKEPKKFQTAYAKKTGDQKGYREALCKWIDFTRDFLSKYTKTTSI
DLSSLRPSSQYKDLGEYYAELNPLLYHISFQRIAEKEIMDAVETGKLYLFQIYNKDFAKGHHGKPNLHTLYWTGLFS
PENLAKTSIKLNGQAELFYRPKSRMKRMAHRLGEKMLNKKLKDQKTPIPDTLYQELYDYVNHRLSHDLSDEARALLP
NVITKEVSHEIIKDRRFTSDKFFFHVPITLNYQAANSPSKFNQRVNAYLKEHPETPIIGIDRGERNLIYITVIDSTG
KILEQRSLNTIQQFDYQKKLDNREKERVAARQAWSVVGTIKDLKQGYLSQVIHEIVDLMIHYQAVVVLENLNFGFKS
KRTGIAEKAVYQQFEKMLIDKLNCLVLKDYPAEKVGGVLNPYQLTDQFTSFAKMGTQSGFLFYVPAPYTSKIDPLTG
FVDPFVWKTIKNHESRKHFLEGFDFLHYDVKTGDFILHFKMNRNLSFQRGLPGFMPAWDIVFEKNETQFDAKGTPFI
AGKRIVPVIENHRFTGRYRDLYPANELIALLEEKGIVFRDGSNILPKLLENDDSHAIDTMVALIRSVLQMRNSNAAT
GEDYINSPVRDLNGVCFDSRFQNPEWPMDADANGAYHIALKGQLLLNHLKESKDLKLQNGISNQDWLAYIQELRN
GGGGSEAAAKGGGGS*MVSKGEELFTGVVPILVELDGDVNGHKFSVSGEGEGDATYGKLTKFICTTGKLPVPWPTL
VTTLTYGVQCFSRYPDHMKQHDFFKSAMPEGYVQERTIFFKDDGNYKTRAEVKFEGDTLVNRIELKGIDFKEDGNI
LGHKLEYNYNSHVYIMADKQKNGIKVNFKIRHNIEDGSVQLADHYQQNTPIGDGPVLLPDNHYLSTQSALSKDPN
EKRDHMVLLEFVTAAGITLGMDELYK*
```

Table V.4 provides chimera fusion proteins between AsCas12a amino acid sequences, linker amino acid sequences (underlined), and mCherry amino acid sequences (bolded, italicized).

TABLE V.4

AsCas12a-Linker-mCherry Chimeras

```
SEQ ID NO: 140
MTQFEGFTNLYQVSKTLRFELIPQGKILKHIQEQGFIEEDKARNDHYKELKPIIDRIYKTYADQCLQLVQLDWENLS
AAIDSYRKEKTEETRNALIEEQATYRNAIHDYFIGRIDNLTDAINKRHAEIYKGLFKAELENGKVLKQLGTVITTEH
ENALLRSEDKETTYFSGEYENRKNVESAEDISTAIPHRIVQDNFPKEKENCHIFTRLITAVPSLREHFENVKKAIGI
FVSTSIEEVESPPFYNQLLTQTQIDLYNQLLGGISREAGTEKIKGLNEVLNLAIQKNDETAHIIASLPHRFIPLEKQ
ILSDRNTLSFILEEEKSDEEVIQSECKYKILLRNENVLETAEALFNELNSIDLTHIFISHKKLETISSALCDHWDTL
RNALYERRISELTGKITKSAKEKVQRSLKHEDINLQEIISAAGKELSEAFKQKTSEILSHAHAALDQPLPTTLKKQE
EKEILKSQLDSLLGLYHLLDWFAVDESNEVDPEFSARLIGIKLEMEPSLSFYNKARNYATKKPYSVEKFKLNFQMPT
LASGWDVNKEKNNGAILFVKNGLYYLGIMPKQKGRYKALSFEPTEKTSEGFDKMYYDYFPDAAKMIPKCSTQLKAVT
AHFQTHTTPILLSNNFIEPLEITKEIYDLNNPEKEPKKFQTAYAKKTGDQKGYREALCKWIDETRDELSKYTKITSI
DLSSLRPSSQYKDLGEYYAELNPLLYHISFQRIAEKEIMDAVETGKLYLFQIYNKDFAKGHHGKPNLHTLYWTGLFS
PENLAKTSIKLNGQAELFYRPKSRMKRMAHRLGEKMLNKKLKDQKTPIPDTLYQELYDYVNHRLSHDLSDEARALLP
NVITKEVSHEIIKDRRFTSDKEFFHVPITLNYQAANSPSKENQRVNAYLKEHPETPIIGIDRGERNLIYITVIDSTG
KILEQRSLNTIQQFDYQKKLDNREKERVAARQAWSVVGTIKDLKQGYLSQVIHEIVDLMIHYQAVVVLENLNEGEKS
KRTGIAEKAVYQQFEKMLIDKLNCLVLKDYPAEKVGGVLNPYQLTDQFTSFAKMGTQSGELFYVPAPYTSKIDPLIG
FVDPFVWKTIKNHESRKHFLEGFDFLHYDVKTGDFILHFKMNRNLSFQRGLPGEMPAWDIVFEKNETQFDAKGTPFI
```

TABLE V.4-continued

AsCas12a-Linker-mCherry Chimeras

AGKRIVPVIENHRFTGRYRDLYPANELIALLEEKGIVERDGSNILPKLLENDDSHAIDTMVALIRSVLQMRNSNAAT
GEDYINSPVRDLNGVCEDSREQNPEWPMDADANGAYHIALKGQLLLNHLKESKDLKLQNGISNQDWLAYIQELRN
GSAGSAAGSGEF
*MVSKGEELFTGVVPILVELDGDVNGHKFSVSGEGEGDATYGKLTLKFICTTGKLPVPWPTLVTT*
*LTYGVQCFSRYPDHMKQHDFFKSAMPEGYVQERTIFFKDDGNYKTRAEVKFEGDTLVNRIELKGIDFKEDGNILGH*
*KLEYNYNSHNVYIMADKQKNGIKVNFKIRHNIEDGSVQLADHYQQNTPIGDGPVLLPDNHYLSTQSALSKDPNEKR*
*DHMVLLEFVTAAGITLGMDELYK*

SEQ ID NO: 141
MTQFEGFTNLYQVSKTLRFELIPQGKILKHIQEQGFIEEDKARNDHYKELKPIIDRIYKTYADQCLQLVQLDWENLS
AAIDSYRKEKTEETRNALIEEQATYRNAIHDYFIGRIDNLTDAINKRHAEIYKGLFKAELENGKVLKQLGTVITTEH
ENALLRSEDKETTYFSGEYENRKNVESAEDISTAIPHRIVQDNFPKEKENCHIFTRLITAVPSLREHFENVKKAIGI
FVSTSIEEVESPFPYNQLLTQTQIDLYNQLLGGISREAGTEKIKGLNEVLNLAIQKNDETAHIIASLPHRFIPLEKQ
ILSDRNTLSFILEEEKSDEEVIQSECKYKILLRNENVLETAEALFNELNSIDLTHIFISHKKLETISSALCDHWDTL
RNALYERRISELTGKITKSAKEKVQRSLKHEDINLQEIISAAGKELSEAFKQKTSEILSHAHAALDQPLPTLLKKQE
EKEILKSQLDSLLGLYHLLDWFAVDESNEVDPEFSARLIGIKLEMEPSLSFYNKARNYATKKPYSVEKFKLNFQMPT
LASGWDVNKEKNNGAILFVKNGLYYLGIMPKQKGRYKALSFEPTEKTSEGFDKMYYDYFPDAAKMIPKCSTQLKAVT
AHFQTHTTPILLSNNFIEPLEITKEIYDLNNPEKEPKKFQTAYAKKTGDQKGYREALCKWIDETRDELSKYTKITSI
DLSSLRPSSQYKDLGEYYAELNPLLYHISFQRIAEKEIMDAVETGKLYLFQIYNKDFAKGHHGKPNLHTLYWTGLFS
PENLAKTSIKLNGQAELFYRPKSRMKRMAHRLGEKMLNKKLKDQKTPIPDTLYQELYDYVNHRLSHDLSDEARALLP
NVITKEVSHEIIKDRRFTSDKEFFHVPITLNYQAANSPSKENQRVNAYLKEHPETPIIGIDRGERNLIYITVIDSTG
KILEQRSLNTIQQFDYQKKLDNREKERVAARQAWSVVGTIKDLKQGYLSQVIHEIVDLMIHYQAVVVLENLNEGEKS
KRTGIAEKAVYQQFEKMLIDKLNCLVLKDYPAEKVGGVLNPYQLTDQFTSFAKMGTQSGELFYVPAPYTSKIDPLIG
FVDPFVWKTIKNHESRKHFLEGFDFLHYDVKTGDFILHFKMNRNLSFQRGLPGEMPAWDIVFEKNETQFDAKGTPFI
AGKRIVPVIENHRFTGRYRDLYPANELIALLEEKGIVERDGSNILPKLLENDDSHAIDTMVALIRSVLQMRNSNAAT
GEDYINSPVRDLNGVCEDSREQNPEWPMDADANGAYHIALKGQLLLNHLKESKDLKLQNGISNQDWLAYIQELRN
GGGGSGGGGSGGGGSGGGGS
*MVSKGEELFTGVVPILVELDGDVNGHKFSVSGEGEGDATYGKLTLKFICTTGKLPVPWPTLVTT*
*LTYGVQCFSRYPDHMKQHDFFKSAMPEGYVQERTIFFKDDGNYKTRAEVKFEGDTLVNRIELKGIDFKEDGNILGH*
*KLEYNYNSHNVYIMADKQKNGIKVNFKIRHNIEDGSVQLADHYQQNTPIGDGPVLLPDNHYLSTQSALSKDPNEKR*
*DHMVLLEFVTAAGITLGMDELYK*

SEQ ID NO: 142
MTQFEGFTNLYQVSKTLRFELIPQGKILKHIQEQGFIEEDKARNDHYKELKPIIDRIYKTYADQCLQLVQLDWENLS
AAIDSYRKEKTEETRNALIEEQATYRNAIHDYFIGRIDNLTDAINKRHAEIYKGLFKAELENGKVLKQLGTVITTEH
ENALLRSEDKETTYFSGEYENRKNVESAEDISTAIPHRIVQDNFPKEKENCHIFTRLITAVPSLREHFENVKKAIGI
FVSTSIEEVESPFPYNQLLTQTQIDLYNQLLGGISREAGTEKIKGLNEVLNLAIQKNDETAHIIASLPHRFIPLEKQ
ILSDRNTLSFILEEEKSDEEVIQSECKYKILLRNENVLETAEALFNELNSIDLTHIFISHKKLETISSALCDHWDTL
RNALYERRISELTGKITKSAKEKVQRSLKHEDINLQEIISAAGKELSEAFKQKTSEILSHAHAALDQPLPTTLKKQE
EKEILKSQLDSLLGLYHLLDWFAVDESNEVDPEFSARLIGIKLEMEPSLSFYNKARNYATKKPYSVEKFKLNFQMPT
LASGWDVNKEKNNGAILFVKNGLYYLGIMPKQKGRYKALSFEPTEKTSEGFDKMYYDYFPDAAKMIPKCSTQLKAVT
AHFQTHTTPILLSNNFIEPLEITKEIYDLNNPEKEPKKFQTAYAKKTGDQKGYREALCKWIDETRDELSKYTKITSI
DLSSLRPSSQYKDLGEYYAELNPLLYHISFQRIAEKEIMDAVETGKLYLFQIYNKDFAKGHHGKPNLHTLYWTGLFS
PENLAKTSIKLNGQAELFYRPKSRMKRMAHRLGEKMLNKKLKDQKTPIPDTLYQELYDYVNHRLSHDLSDEARALLP
NVITKEVSHEIIKDRRFTSDKEFFHVPITLNYQAANSPSKENQRVNAYLKEHPETPIIGIDRGERNLIYITVIDSTG
KILEQRSLNTIQQFDYQKKLDNREKERVAARQAWSVVGTIKDLKQGYLSQVIHEIVDLMIHYQAVVVLENLNEGEKS
KRTGIAEKAVYQQFEKMLIDKLNCLVLKDYPAEKVGGVLNPYQLTDQFTSFAKMGTQSGELFYVPAPYTSKIDPLIG
FVDPFVWKTIKNHESRKHFLEGFDFLHYDVKTGDFILHFKMNRNLSFQRGLPGEMPAWDIVFEKNETQFDAKGTPFI
AGKRIVPVIENHRFTGRYRDLYPANELIALLEEKGIVERDGSNILPKLLENDDSHAIDTMVALIRSVLQMRNSNAAT
GEDYINSPVRDLNGVCEDSREQNPEWPMDADANGAYHIALKGQLLLNHLKESKDLKLQNGISNQDWLAYIQELRN
AEAAAKEAAAKEAAAKEAAAKA
*MVSKGEELFTGVVPILVELDGDVNGHKFSVSGEGEGDATYGKLTLKFICTTGKLPVPWPTLVTT*
*LTYGVQCFSRYPDHMKQHDFFKSAMPEGYVQERTIFFKDDGNYKTRAEVKFEGDTLVNRIELKGIDFKEDGNILGH*
*KLEYNYNSHNVYIMADKQKNGIKVNFKIRHNIEDGSVQLADHYQQNTPIGDGPVLLPDNHYLSTQSALSKDPNEKR*
*DHMVLLEFVTAAGITLGMDELYK*

SEQ ID NO: 143
MTQFEGFTNLYQVSKTLRFELIPQGKTLKHIQEQGFIEEDKARNDHYKELKPIIDRIYKTYADQCLQLVQLDWENLS
AAIDSYRKEKTEETRNALIEEQATYRNAIHDYFIGRIDNLTDAINKRHAEIYKGLFKAELENGKVLKQLGTVITTEH
ENALLRSEDKETTYFSGEYENRKNVESAEDISTAIPHRIVQDNFPKEKENCHIFTRLITAVPSLREHFENVKKAIGI
FVSTSIEEVESPFPYNQLLTQTQIDLYNQLLGGISREAGTEKIKGLNEVLNLAIQKNDETAHIIASLPHRFIPLEKQ
ILSDRNTLSFILEEEKSDEEVIQSECKYKILLRNENVLETAEALFNELNSIDLTHIFISHKKLETISSALCDHWDTL
RNALYERRISELTGKITKSAKEKVQRSLKHEDINLQEIISAAGKELSEAFKQKTSEILSHAHAALDQPLPTTLKKQE
EKEILKSQLDSLLGLYHLLDWFAVDESNEVDPEFSARLIGIKLEMEPSLSFYNKARNYATKKPYSVEKFKLNFQMPT
LASGWDVNKEKNNGAILFVKNGLYYLGIMPKQKGRYKALSFEPTEKTSEGFDKMYYDYFPDAAKMIPKCSTQLKAVT
AHFQTHTTPILLSNNFIEPLEITKEIYDLNNPEKEPKKFQTAYAKKTGDQKGYREALCKWIDETRDELSKYTKITSI
DLSSLRPSSQYKDLGEYYAELNPLLYHISFQRIAEKEIMDAVETGKLYLFQIYNKDFAKGHHGKPNLHTLYWTGLFS
PENLAKTSIKLNGQAELFYRPKSRMKRMAHRLGEKMLNKKLKDQKTPIPDTLYQELYDYVNHRLSHDLSDEARALLP
NVITKEVSHEIIKDRRFTSDKEFFHVPITLNYQAANSPSKENQRVNAYLKEHPETPIIGIDRGERNLIYITVIDSTG
KILEQRSLNTIQQFDYQKKLDNREKERVAARQAWSVVGTIKDLKQGYLSQVIHEIVDLMIHYQAVVVLENLNEGEKS
KRTGIAEKAVYQQFEKMLIDKLNCLVLKDYPAEKVGGVLNPYQLTDQFTSFAKMGTQSGELFYVPAPYTSKIDPLIG
FVDPFVWKTIKNHESRKHFLEGFDFLHYDVKTGDFILHFKMNRNLSFQRGLPGEMPAWDIVFEKNETQFDAKGTPFI
AGKRIVPVIENHRFTGRYRDLYPANELIALLEEKGIVERDGSNILPKLLENDDSHAIDTMVALIRSVLQMRNSNAAT
GEDYINSPVRDLNGVCEDSREQNPEWPMDADANGAYHIALKGQLLLNHLKESKDLKLQNGISNQDWLAYIQELRN
AEAAAKEAAAKEAAAKEAAAKALEAEAAAKEAAAKEAAAKEAAAKA
*MVSKGEELFTGVVPILVELDGDVNGHKFSVSGEGEGDATYGKLTLKFICTTGKLPVPWPTLVTT*
*LTYGVQCFSRYPDHMKQHDFFKSAMPEGYVQERTIFFKDDGNYKTRAEVKFEGDTLVNRIELKGIDFKEDGNILGH*

TABLE V.4-continued

AsCas12a-Linker-mCherry Chimeras

*KLEYNYNSHNVYIMADKQKNGIKVNFKIRHNIEDGSVQLADHYQQNTPIGDGPVLLPDNHYLSTQSALSKDPNEKR*
*DHMVLLEFVTAAGITLGMDELYK*

SEQ ID NO: 144
MTQFEGFTNLYQVSKTLRFELIPQGKTLKHIQEQGFIEEDKARNDHYKELKPIIDRIYKTYADQCLQLVQLDWENLS
AAIDSYRKEKTEETRNALIEEQATYRNAIHDYFIGRIDNLTDAINKRHAEIYKGLFKAELENGKVLKQLGTVITTEH
ENALLRSEDKETTYFSGEYENRKNVESAEDISTAIPHRIVQDNFPKEKENCHIFTRLITAVPSLREHFENVKKAIGI
FVSTSIEEVESFPFYNQLLTQTQIDLYNQLLGGISREAGTEKIKGLNEVLNLAIQKNDETAHIIASLPHRFIPLEKQ
ILSDRNTLSFILEEEKSDEEVIQSECKYKILLRNENVLETAEALFNELNSIDLTHIFISHKKLETISSALCDHWDTL
RNALYERRISELTGKITKSAKEKVQRSLKHEDINLQEIISAAGKELSEAFKQKTSEILSHAHAALDQPLPTTLKKQE
EKEILKSQLDSLLGLYHLLDWFAVDESNEVDPEFSARLIGIKLEMEPSLSFYNKARNYATKKPYSVEKFKLNFQMPT
LASGWDVNKEKNNGAILFVKNGLYYLGIMPKQKGRYKALSFEPTEKTSEGFDKMYYDYFPDAAKMIPKCSTQLKAVT
AHFQTHTTPILLSNNFIEPLEITKEIYDLNNPEKEPKKFQTAYAKKTGDQKGYREALCKWIDETRDELSKYTKITSI
DLSSLRPSSQYKDLGEYYAELNPLLYHISFQRIAEKEIMDAVETGKLYLFQIYNKDFAKGHHGKPNLHTLYWTGLFS
PENLAKTSIKLNGQAELFYRPKSRMKRMAHRLGEKMLNKKLKDQKTPIPDTLYQELYDYVNHRLSHDLSDEARALLP
NVITKEVSHEIIKDRRFTSDKEFFHVPITLNYQAANSPSKENQRVNAYLKEHPETPIIGIDRGERNLIYITVIDSTG
KILEQRSLNTIQQFDYQKKLDNREKERVAARQAWSVVGTIKDLKQGYLSQVIHEIVDLMIHYQAVVVLENLNEGEKS
KRTGIAEKAVYQQFEKMLIDKLNCLVLKDYPAEKVGGVLNPYQLTDQFTSFAKMGTQSGELFYVPAPYTSKIDPLIG
FVDPFVWKTIKNHESRKHFLEGFDFLHYDVKTGDFILHFKMNRNLSFQRGLPGEMPAWDIVFEKNETQFDAKGTPFI
AGKRIVPVIENHRFTGRYRDLYPANELIALLEEKGIVERDGSNILPKLLENDDSHAIDTMVALIRSVLQMRNSNAAT
GEDYINSPVRDLNGVCEDSREQNPEWPMDADANGAYHIALKGQLLLNHLKESKDLKLQNGISNQDWLAYIQELRN
LEAEAAAKEAAAKEAAAKEAAAKALEAEAAAKEAAAKEAAAKEAAAKALE
*MVSKGEELFTGVVPILVELDGDVNGHKFSVSGEGEGDATYGKLTLKFICTTGKLPVPWPTLVTT*
*LTYGVQCFSRYPDHMKQHDFFKSAMPEGYVQERTIFFKDDGNYKTRAEVKFEGDTLVNRIELKGIDFKEDGNILGH*
*KLEYNYNSHNVYIMADKQKNGIKVNFKIRHNIEDGSVQLADHYQQNTPIGDGPVLLPDNHYLSTQSALSKDPNEKR*
*DHMVLLEFVTAAGITLGMDELYK*

SEQ ID NO: 145
MTQFEGFTNLYQVSKTLRFELIPQGKTLKHIQEQGFIEEDKARNDHYKELKPIIDRIYKTYADQCLQLVQLDWENLS
AAIDSYRKEKTEETRNALIEEQATYRNAIHDYFIGRIDNLTDAINKRHAEIYKGLFKAELENGKVLKQLGTVITTEH
ENALLRSEDKETTYFSGEYENRKNVESAEDISTAIPHRIVQDNFPKEKENCHIFTRLITAVPSLREHFENVKKAIGI
FVSTSIEEVESFPFYNQLLTQTQIDLYNQLLGGISREAGTEKIKGLNEVLNLAIQKNDETAHIIASLPHRFIPLEKQ
ILSDRNTLSFILEEEKSDEEVIQSECKYKILLRNENVLETAEALFNELNSIDLTHIFISHKKLETISSALCDHWDTL
RNALYERRISELTGKITKSAKEKVQRSLKHEDINLQEIISAAGKELSEAFKQKTSEILSHAHAALDQPLPTTLKKQE
EKEILKSQLDSLLGLYHLLDWFAVDESNEVDPEFSARLIGIKLEMEPSLSFYNKARNYATKKPYSVEKFKLNFQMPT
LASGWDVNKEKNNGAILFVKNGLYYLGIMPKQKGRYKALSFEPTEKTSEGFDKMYYDYFPDAAKMIPKCSTQLKAVT
AHFQTHTTPILLSNNFIEPLEITKEIYDLNNPEKEPKKFQTAYAKKTGDQKGYREALCKWIDETRDELSKYTKITSI
DLSSLRPSSQYKDLGEYYAELNPLLYHISFQRIAEKEIMDAVETGKLYLFQIYNKDFAKGHHGKPNLHTLYWTGLFS
PENLAKTSIKLNGQAELFYRPKSRMKRMAHRLGEKMLNKKLKDQKTPIPDTLYQELYDYVNHRLSHDLSDEARALLP
NVITKEVSHEIIKDRRFTSDKEFFHVPITLNYQAANSPSKENQRVNAYLKEHPETPIIGIDRGERNLIYITVIDSTG
KILEQRSLNTIQQFDYQKKLDNREKERVAARQAWSVVGTIKDLKQGYLSQVIHEIVDLMIHYQAVVVLENLNEGEKS
KRTGIAEKAVYQQFEKMLIDKLNCLVLKDYPAEKVGGVLNPYQLTDQFTSFAKMGTQSGELFYVPAPYTSKIDPLIG
FVDPFVWKTIKNHESRKHFLEGFDFLHYDVKTGDFILHFKMNRNLSFQRGLPGEMPAWDIVFEKNETQFDAKGTPFI
AGKRIVPVIENHRFTGRYRDLYPANELIALLEEKGIVERDGSNILPKLLENDDSHAIDTMVALIRSVLQMRNSNAAT
GEDYINSPVRDLNGVCEDSREQNPEWPMDADANGAYHIALKGQLLLNHLKESKDLKLQNGISNQDWLAYIQELRN
APA
*MVSKGEELFTGVVPILVELDGDVNGHKFSVSGEGEGDATYGKLTLKFICTTGKLPVPWPTLVTT*
*LTYGVQCFSRYPDHMKQHDFFKSAMPEGYVQERTIFFKDDGNYKTRAEVKFEGDTLVNRIELKGIDFKEDGNILGH*
*KLEYNYNSHNVYIMADKQKNGIKVNFKIRHNIEDGSVQLADHYQQNTPIGDGPVLLPDNHYLSTQSALSKDPNEKR*
*DHMVLLEFVTAAGITLGMDELYK*

SEQ ID NO: 146
MTQFEGFTNLYQVSKTLRFELIPQGKILKHIQEQGFIEEDKARNDHYKELKPIIDRIYKTYADQCLQLVQLDWENLS
AAIDSYRKEKTEETRNALIEEQATYRNAIHDYFIGRIDNLTDAINKRHAEIYKGLFKAELENGKVLKQLGTVITTEH
ENALLRSEDKETTYFSGEYENRKNVESAEDISTAIPHRIVQDNFPKEKENCHIFTRLITAVPSLREHFENVKKAIGI
FVSTSIEEVESFPFYNQLLTQTQIDLYNQLLGGISREAGTEKIKGLNEVLNLAIQKNDETAHIIASLPHRFIPLEKQ
ILSDRNTLSFILEEEKSDEEVIQSECKYKILLRNENVLETAEALFNELNSIDLTHIFISHKKLETISSALCDHWDTL
RNALYERRISELTGKITKSAKEKVQRSLKHEDINLQEIISAAGKELSEAFKQKTSEILSHAHAALDQPLPTTLKKQE
EKEILKSQLDSLLGLYHLLDWFAVDESNEVDPEFSARLIGIKLEMEPSLSFYNKARNYATKKPYSVEKFKLNFQMPT
LASGWDVNKEKNNGAILFVKNGLYYLGIMPKQKGRYKALSFEPTEKTSEGFDKMYYDYFPDAAKMIPKCSTQLKAVT
AHFQTHTTPILLSNNFIEPLEITKEIYDLNNPEKEPKKFQTAYAKKTGDQKGYREALCKWIDETRDELSKYTKITSI
DLSSLRPSSQYKDLGEYYAELNPLLYHISFQRIAEKEIMDAVETGKLYLFQIYNKDFAKGHHGKPNLHTLYWTGLFS
PENLAKTSIKLNGQAELFYRPKSRMKRMAHRLGEKMLNKKLKDQKTPIPDTLYQELYDYVNHRLSHDLSDEARALLP
NVITKEVSHEIIKDRRFTSDKEFFHVPITLNYQAANSPSKENQRVNAYLKEHPETPIIGIDRGERNLIYITVIDSTG
KILEQRSLNTIQQFDYQKKLDNREKERVAARQAWSVVGTIKDLKQGYLSQVIHEIVDLMIHYQAVVVLENLNEGEKS
KRTGIAEKAVYQQFEKMLIDKLNCLVLKDYPAEKVGGVLNPYQLTDQFTSFAKMGTQSGELFYVPAPYTSKIDPLIG
FVDPFVWKTIKNHESRKHFLEGFDFLHYDVKTGDFILHFKMNRNLSFQRGLPGEMPAWDIVFEKNETQFDAKGTPFI
AGKRIVPVIENHRFTGRYRDLYPANELIALLEEKGIVERDGSNILPKLLENDDSHAIDTMVALIRSVLQMRNSNAAT
GEDYINSPVRDLNGVCEDSREQNPEWPMDADANGAYHIALKGQLLLNHLKESKDLKLQNGISNQDWLAYIQELRN
APAPA
*MVSKGEELFTGVVPILVELDGDVNGHKFSVSGEGEGDATYGKLTLKFICTTGKLPVPWPTLVTT*
*LTYGVQCFSRYPDHMKQHDFFKSAMPEGYVQERTIFFKDDGNYKTRAEVKFEGDTLVNRIELKGIDFKEDGNILGH*
*KLEYNYNSHNVYIMADKQKNGIKVNFKIRHNIEDGSVQLADHYQQNTPIGDGPVLLPDNHYLSTQSALSKDPNEKR*
*DHMVLLEFVTAAGITLGMDELYK*

SEQ ID NO: 147
MTQFEGFTNLYQVSKTLRFELIPQGKILKHIQEQGFIEEDKARNDHYKELKPIIDRIYKTYADQCLQLVQLDWENLS
AAIDSYRKEKTEETRNALIEEQATYRNAIHDYFIGRIDNLTDAINKRHAEIYKGLFKAELENGKVLKQLGTVITTEH

TABLE V.4-continued

AsCas12a-Linker-mCherry Chimeras

ENALLRSEDKETTYFSGEYENRKNVESAEDISTAIPHRIVQDNFPKEKENCHIFTRLITAVPSLREHFENVKKAIGI
FVSTSIEEVESPPFYNQLLTQTQIDLYNQLLGGISREAGTEKIKGLNEVLNLAIQKNDETAHIIASLPHRFIPLEKQ
ILSDRNTLSFILEEEKSDEEVIQSECKYKILLRNENVLETAEALFNELNSIDLTHIFISHKKLETISSALCDHWDTL
RNALYERRISELTGKITKSAKEKVQRSLKHEDINLQEIISAAGKELSEAFKQKTSEILSHAHAALDQPLPTTLKKQE
EKEILKSQLDSLLGLYHLLDWFAVDESNEVDPEFSARLIGIKLEMEPSLSFYNKARNYATKKPYSVEKFKLNFQMPT
LASGWDVNKEKNNGAILFVKNGLYYLGIMPKQKGRYKALSFEPTEKTSEGFDKMYYDYFPDAAKMIPKCSTQLKAVT
AHFQTHTTPILLSNNFIEPLEITKEIYDLNNPEKEPKKFQTAYAKKTGDQKGYREALCKWIDETRDELSKYTKITSI
DLSSLRPSSQYKDLGEYYAELNPLLYHISFQRIAEKEIMDAVETGKLYLFQIYNKDFAKGHHGKPNLHTLYWTGLFS
PENLAKTSIKLNGQAELFYRPKSRMKRMAHRLGEKMLNKKLKDQKTPIPDTLYQELYDYVNHRLSHDLSDEARALLP
NVITKEVSHEIIKDR RFTSDKEFFHVPITLNYQAANSPSKFNQRVNAYLKEHPETPIIGIDRGERNLIYITVIDSTG
KILEQRSLNTIQQFDYQKKLDNREKERVAARQAWSVVGTIKDLKQGYLSQVIHEIVDLMIHYQAVVVLENLNEGEKS
KRTGIAEKAVYQQFEKMLIDKLNCLVLKDYPAEKVGGVLNPYQLTDQFTSFAKMGTQSGELFYVPAPYTSKIDPLTG
FVDPFVWKTIKNHESRKHFLEGFDFLHYDVKTGDFILHFKMNRNLSFQRGLPGEMPAWDIVFEKNETQFDAKGTPFI
AGKRIVPVIENHRFTGRYRDLYPANELIALLEEKGIVFRDGSNILPKLLENDDSHAIDTMVALIRSVLQMRSNAAT
GEDYINSPVRDLNGVCEDSREQNPEWPMDADANGAYHIALKGQLLLNHLKESKDLKLQNGISNQDWLAYIQELRN
APAPAPA
*MVSKGEELFTGVVPILVELDGDVNGHKFSVSGEGEGDATYGKLTLKFICTTGKLPVPWPTLVTT*
*LTYGVQCFSRYPDHMKQHDFFKSAMPEGYVQERTIFFKDDGNYKTRAEVKFEGDTLVNRIELKGIDFKEDGNILGH*
*KLEYNYNSHNVYIMADKQKNGIKVNFKIRHNIEDGSVQLADHYQQNTPIGDGPVLLPDNHYLSTQSALSKDPNEKR*
*DHMVLLEFVTAAGITLGMDELYK*

SEQ ID NO: 148
MTQFEGFTNLYQVSKTLRFELIPQGKTLKHIQEQGFIEEDKARNDHYKELKPIIDRIYKTYADQCLQLVQLDWENLS
AAIDSYRKEKTEETRNALIEEQATYRNAIHDYFIGRIDNLTDAINKRHAEIYKGLFKAELENGKVLKQLGTVITTEH
ENALLRSFDKETTYFSGEYENRKNVESAEDISTAIPHRIVQDNFPKEKENCHIFTRLITAVPSLREHFENVKKAIGI
FVSTSIEEVFSPPFYNQLLTQTQIDLYNQLLGGISREAGTEKIKGLNEVLNLAIQKNDETAHIIASLPHRFIPLFKQ
ILSDRNTLSFILEEFKSDEEVIQSFCKYKILLRNENVLETAEALFNELNSIDLTHIFISHKKLETISSALCDHWDTL
RNALYERRISELTGKITKSAKEKVQRSLKHEDINLQEIISAAGKELSEAFKQKTSEILSHAHAALDQPLPTTLKKQE
EKEILKSQLDSLLGLYHLLDWFAVDESNEVDPEFSARLTGIKLEMEPSLSFYNKARNYATKKPYSVEKFKLNFQMPT
LASGWDVNKEKNNGAILFVKNGLYYLGIMPKQKGRYKALSFEPTEKTSEGFDKMYYDYFPDAAKMIPKCSTQLKAVT
AHFQTHTTPILLSNNFIEPLEITKEIYDLNNPEKEPKKFQTAYAKKTGDQKGYREALCKWIDETRDELSKYTKITSI
DLSSLRPSSQYKDLGEYYAELNPLLYHISFQRIAEKEIMDAVETGKLYLFQIYNKDFAKGHHGKPNLHTLYWTGLFS
PENLAKTSIKLNGQAELFYRPKSRMKRMAHRLGEKMLNKKLKDQKTPIPDTLYQELYDYVNHRLSHDLSDEARALLP
NVITKEVSHEIIKDRRFTSDKEFFHVPITLNYQAANSPSKFNQRVNAYLKEHPETPIIGIDRGERNLIYITVIDSTG
KILEQRSLNTIQQFDYQKKLDNREKERVAARQAWSVVGTIKDLKQGYLSQVIHEIVDLMIHYQAVVVLENLNEGEKS
KRTGIAEKAVYQQFEKMLIDKLNCLVLKDYPAEKVGGVLNPYQLTDQFTSFAKMGTQSGELFYVPAPYTSKIDPLTG
FVDPFVWKTIKNHESRKHFLEGFDFLHYDVKTGDFILHFKMNRNLSFQRGLPGEMPAWDIVFEKNETQFDAKGTPFI
AGKRIVPVIENHRFTGRYRDLYPANELIALLEEKGIVFRDGSNILPKLLENDDSHAIDTMVALIRSVLQMRSNAAT
GEDYINSPVRDLNGVCEDSREQNPEWPMDADANGAYHIALKGQLLLNHLKESKDLKLQNGISNQDWLAYIQELRN
APAPAPAPA
*MVSKGEELFTGVVPILVELDGDVNGHKFSVSGEGEGDATYGKLTLKFICTTGKLPVPWPTLVTT*
*LTYGVQCFSRYPDHMKQHDFFKSAMPEGYVQERTIFFKDDGNYKTRAEVKFEGDTLVNRIELKGIDFKEDGNILGH*
*KLEYNYNSHNVYIMADKQKNGIKVNFKIRHNIEDGSVQLADHYQQNTPIGDGPVLLPDNHYLSTQSALSKDPNEKR*
*DHMVLLEFVTAAGITLGMDELYK*

SEQ ID NO: 149
MTQFEGFTNLYQVSKTLRFELIPQGKTLKHIQEQGFIEEDKARNDHYKELKPIIDRIYKTYADQCLQLVQLDWENLS
AAIDSYRKEKTEETRNALIEEQATYRNAIHDYFIGRIDNLTDAINKRHAEIYKGLFKAELENGKVLKQLGTVITTEH
ENALLRSFDKETTYFSGEYENRKNVESAEDISTAIPHRIVQDNFPKEKENCHIFTRLITAVPSLREHFENVKKAIGI
FVSTSIEEVFSPPFYNQLLTQTQIDLYNQLLGGISREAGTEKIKGLNEVLNLAIQKNDETAHIIASLPHRFIPLFKQ
ILSDRNTLSFILEEFKSDEEVIQSFCKYKILLRNENVLETAEALFNELNSIDLTHIFISHKKLETISSALCDHWDTL
RNALYERRISELTGKITKSAKEKVQRSLKHEDINLQEIISAAGKELSEAFKQKTSEILSHAHAALDQPLPTTLKKQE
EKEILKSQLDSLLGLYHLLDWFAVDESNEVDPEFSARLTGIKLEMEPSLSFYNKARNYATKKPYSVEKFKLNFQMPT
LASGWDVNKEKNNGAILFVKNGLYYLGIMPKQKGRYKALSFEPTEKTSEGFDKMYYDYFPDAAKMIPKCSTQLKAVT
AHFQTHTTPILLSNNFIEPLEITKEIYDLNNPEKEPKKFQTAYAKKTGDQKGYREALCKWIDETRDELSKYTKTTSI
DLSSLRPSSQYKDLGEYYAELNPLLYHISFQRIAEKEIMDAVETGKLYLFQIYNKDFAKGHHGKPNLHTLYWTGLFS
PENLAKTSIKLNGQAELFYRPKSRMKRMAHRLGEKMLNKKLKDQKTPIPDTLYQELYDYVNHRLSHDLSDEARALLP
NVITKEVSHEIIKDRRFTSDKEFFHVPITLNYQAANSPSKFNQRVNAYLKEHPETPIIGIDRGERNLIYITVIDSTG
KILEQRSLNTIQQFDYQKKLDNREKERVAARQAWSVVGTIKDLKQGYLSQVIHEIVDLMIHYQAVVVLENLNEGEKS
KRTGIAEKAVYQQFEKMLIDKLNCLVLKDYPAEKVGGVLNPYQLTDQFTSFAKMGTQSGELFYVPAPYTSKIDPLTG
FVDPFVWKTIKNHESRKHFLEGFDFLHYDVKTGDFILHFKMNRNLSFQRGLPGEMPAWDIVFEKNETQFDAKGTPFI
AGKRIVPVIENHRFTGRYRDLYPANELIALLEEKGIVFRDGSNILPKLLENDDSHAIDTMVALIRSVLQMRSNAAT
GEDYINSPVRDLNGVCEDSREQNPEWPMDADANGAYHIALKGQLLLNHLKESKDLKLQNGISNQDWLAYIQELRN
APAPAPAPA
*MVSKGEELFTGVVPILVELDGDVNGHKFSVSGEGEGDATYGKLTLKFICTTGKLPVPWPTLVTT*
*LTYGVQCFSRYPDHMKQHDFFKSAMPEGYVQERTIFFKDDGNYKTRAEVKFEGDTLVNRIELKGIDFKEDGNILGH*
*KLEYNYNSHNVYIMADKQKNGIKVNFKIRHNIEDGSVQLADHYQQNTPIGDGPVLLPDNHYLSTQSALSKDPNEKR*
*DHMVLLEFVTAAGITLGMDELYK*

SEQ ID NO: 150
MTQFEGFTNLYQVSKTLRFELIPQGKILKHIQEQGFIEEDKARNDHYKELKPIIDRIYKTYADQCLQLVQLDWENLS
AAIDSYRKEKTEETRNALIEEQATYRNAIHDYFIGRIDNLTDAINKRHAEIYKGLFKAELENGKVLKQLGTVITTEH
ENALLRSEDKETTYFSGEYENRKNVESAEDISTAIPHRIVQDNFPKEKENCHIFTRLITAVPSLREHFENVKKAIGI
FVSTSIEEVESPPFYNQLLTQTQIDLYNQLLGGISREAGTEKIKGLNEVLNLAIQKNDETAHIIASLPHRFIPLEKQ
ILSDRNTLSFILEEEKSDEEVIQSECKYKILLRNENVLETAEALFNELNSIDLTHIFISHKKLETISSALCDHWDTL
RNALYERRISELTGKITKSAKEKVQRSLKHEDINLQEIISAAGKELSEAFKQKTSEILSHAHAALDQPLPTTLKKQE
EKEILKSQLDSLLGLYHLLDWFAVDESNEVDPEFSARLIGIKLEMEPSLSFYNKARNYATKKPYSVEKFKLNFQMPT
LASGWDVNKEKNNGAILFVKNGLYYLGIMPKQKGRYKALSFEPTEKTSEGFDKMYYDYFPDAAKMIPKCSTQLKAVT

TABLE V.4-continued

AsCas12a-Linker-mCherry Chimeras

AHFQTHTTPILLSNNFIEPLEITKEIYDLNNPEKEPKKFQTAYAKKTGDQKGYREALCKWIDETRDELSKYTKITSI
DLSSLRPSSQYKDLGEYYAELNPLLYHISFQRIAEKEIMDAVETGKLYLFQIYNKDFAKGHHGKPNLHTLYWTGLFS
PENLAKTSIKLNGQAELFYRPKSRMKRMAHRLGEKMLNKKLKDQKTPIPDTLYQELYDYVNHRLSHDLSDEARALLP
NVITKEVSHEIIKDRRFTSDKEFFHVPITLNYQAANSPSKENQRVNAYLKEHPETPIIGIDRGERNLIYITVIDSTG
KILEQRSLNTIQQFDYQKKLDNREKERVAARQAWSVVGTIKDLKQGYLSQVIHEIVDLMIHYQAVVVLENLNEGEKS
KRTGIAEKAVYQQFEKMLIDKLNCLVLKDYPAEKVGGVLNPYQLTDQFTSFAKMGTQSGELFYVPAPYTSKIDPLIG
FVDPFVWKTIKNHESRKHFLEGFDFLHYDVKTGDFILHFKMNRLSFQRGLPGEMPAWDIVFEKNETQFDAKGTPFI
AGKRIVPVIENHRFTGRYRDLYPANELIALLEEKGIVERDGSNILPKLLENDDSHAIDTMVALIRSVLQMRNSNAAT
GEDYINSPVRDLNGVCEDSREQNPEWPMDADANGAYHIALKGQLLLNHLKESKDLKLQNGISNQDWLAYIQELRN
APAPAPAPAPAPA
*MVSKGEELFTGVVPILVELDGDVNGHKFSVSGEGEGDATYGKLTLKFICTTGKLPVPWPTLVTT*
*LTYGVQCFSRYPDHMKQHDFFKSAMPEGYVQERTIFFKDDGNYKTRAEVKFEGDTLVNRIELKGIDFKEDGNILGH*
*KLEYNYNSHNVYIMADKQKNGIKVNFKIRHNIEDGSVQLADHYQQNTPIGDGPVLLPDNHYLSTQSALSKDPNEKR*
*DHMVLLEFVTAAGITLGMDELYK*

SEQ ID NO: 151
MTQFEGFTNLYQVSKTLRFELIPQGKILKHIQEQGFIEEDKARNDHYKELKPIIDRIYKTYADQCLQLVQLDWENLS
AAIDSYRKEKTEETRNALIEEQATYRNAIHDYFIGRIDNLTDAINKRHAEIYKGLFKAELENGKVLKQLGTVITTEH
ENALLRSEDKETTYFSGEYENRKNVESAEDISTAIPHRIVQDNFPKEKENCHIFTRLITAVPSLREHFENVKKAIGI
FVSTSIEEVESFPFYNQLLTQTQIDLYNQLLGGISREAGTEKIKGLNEVLNLAIQKNDETAHIIASLPHRFIPLEKQ
ILSDRNTLSFILEEEKSDEEVIQSECKYKILLRNENVLETAEALFNELNSIDLTHIFISHKKLETISSALCDHWDTL
RNALYERRISELTGKITKSAKEKVQRSLKHEDINLQEIISAAGKELSEAFKQKTSEILSHAHAALDQPLPTTLKKQE
EKEILKSQLDSLLGLYHLLDWFAVDESNEVDPEFSARLIGIKLEMEPSLSFYNKARNYATKKPYSVEKFKLNFQMPT
LASGWDVNKEKNNGAILFVKNGLYYLGIMPKQKGRYKALSFEPTEKTSEGFDKMYYDYFPDAAKMIPKCSTQLKAVT
AHFQTHTTPILLSNNFIEPLEITKEIYDLNNPEKEPKKFQTAYAKKTGDQKGYREALCKWIDETRDELSKYTKITSI
DLSSLRPSSQYKDLGEYYAELNPLLYHISFQRIAEKEIMDAVETGKLYLFQIYNKDFAKGHHGKPNLHTLYWTGLFS
PENLAKTSIKLNGQAELFYRPKSRMKRMAHRLGEKMLNKKLKDQKTPIPDTLYQELYDYVNHRLSHDLSDEARALLP
NVITKEVSHEIIKDRRFTSDKEFFHVPITLNYQAANSPSKENQRVNAYLKEHPETPIIGIDRGERNLIYITVIDSTG
KILEQRSLNTIQQFDYQKKLDNREKERVAARQAWSVVGTIKDLKQGYLSQVIHEIVDLMIHYQAVVVLENLNEGEKS
KRTGIAEKAVYQQFEKMLIDKLNCLVLKDYPAEKVGGVLNPYQLTDQFTSFAKMGTQSGELFYVPAPYTSKIDPLIG
FVDPFVWKTIKNHESRKHFLEGFDFLHYDVKTGDFILHFKMNRNLSFQRGLPGEMPAWDIVFEKNETQFDAKGTPFI
AGKRIVPVIENHRFTGRYRDLYPANELIALLEEKGIVERDGSNILPKLLENDDSHAIDTMVALIRSVLQMRNSNAAT
GEDYINSPVRDLNGVCEDSREQNPEWPMDADANGAYHIALKGQLLLNHLKESKDLKLQNGISNQDWLAYIQELRN
APAPAPAPAPAPA
*MVSKGEELFTGVVPILVELDGDVNGHKFSVSGEGEGDATYGKLTLKFICTTGKLPVPWPTLVTT*
*LTYGVQCFSRYPDHMKQHDFFKSAMPEGYVQERTIFFKDDGNYKTRAEVKFEGDTLVNRIELKGIDFKEDGNILGH*
*KLEYNYNSHNVYIMADKQKNGIKVNFKIRHNIEDGSVQLADHYQQNTPIGDGPVLLPDNHYLSTQSALSKDPNEKR*
*DHMVLLEFVTAAGITLGMDELYK*

SEQ ID NO: 152
MTQFEGFTNLYQVSKTLRFELIPQGKILKHIQEQGFIEEDKARNDHYKELKPIIDRIYKTYADQCLQLVQLDWENLS
AAIDSYRKEKTEETRNALIEEQATYRNAIHDYFIGRIDNLTDAINKRHAEIYKGLFKAELENGKVLKQLGTVITTEH
ENALLRSEDKETTYFSGEYENRKNVESAEDISTAIPHRIVQDNFPKEKENCHIFTRLITAVPSLREHFENVKKAIGI
FVSTSIEEVESFPFYNQLLTQTQIDLYNQLLGGISREAGTEKIKGLNEVLNLAIQKNDETAHIIASLPHRFIPLEKQ
ILSDRNTLSFILEEEKSDEEVIQSECKYKILLRNENVLETAEALFNELNSIDLTHIFISHKKLETISSALCDHWDTL
RNALYERRISELTGKITKSAKEKVQRSLKHEDINLQEIISAAGKELSEAFKQKTSEILSHAHAALDQPLPTTLKKQE
EKEILKSQLDSLLGLYHLLDWFAVDESNEVDPEFSARLIGIKLEMEPSLSFYNKARNYATKKPYSVEKFKLNFQMPT
LASGWDVNKEKNNGAILFVKNGLYYLGIMPKQKGRYKALSFEPTEKTSEGFDKMYYDYFPDAAKMIPKCSTQLKAVT
AHFQTHTTPILLSNNFIEPLEITKEIYDLNNPEKEPKKFQTAYAKKTGDQKGYREALCKWIDETRDELSKYTKITSI
DLSSLRPSSQYKDLGEYYAELNPLLYHISFQRIAEKEIMDAVETGKLYLFQIYNKDFAKGHHGKPNLHTLYWTGLFS
PENLAKTSIKLNGQAELFYRPKSRMKRMAHRLGEKMLNKKLKDQKTPIPDTLYQELYDYVNHRLSHDLSDEARALLP
NVITKEVSHEIIKDRRFTSDKEFFHVPITLNYQAANSPSKENQRVNAYLKEHPETPIIGIDRGERNLIYITVIDSTG
KILEQRSLNTIQQFDYQKKLDNREKERVAARQAWSVVGTIKDLKQGYLSQVIHEIVDLMIHYQAVVVLENLNEGEKS
KRTGIAEKAVYQQFEKMLIDKLNCLVLKDYPAEKVGGVLNPYQLTDQFTSFAKMGTQSGELFYVPAPYTSKIDPLIG
FVDPFVWKTIKNHESRKHFLEGFDFLHYDVKTGDFILHFKMNRNLSFQRGLPGEMPAWDIVFEKNETQFDAKGTPFI
AGKRIVPVIENHRFTGRYRDLYPANELIALLEEKGIVERDGSNILPKLLENDDSHAIDTMVALIRSVLQMRNSNAAT
GEDYINSPVRDLNGVCEDSREQNPEWPMDADANGAYHIALKGQLLLNHLKESKDLKLQNGISNQDWLAYIQELRN
APAPAPAPAPAPA
*MVSKGEELFTGVVPILVELDGDVNGHKFSVSGEGEGDATYGKLTLKFICTTGKLPVPWPTLVTT*
*LTYGVQCFSRYPDHMKQHDFFKSAMPEGYVQERTIFFKDDGNYKTRAEVKFEGDTLVNRIELKGIDFKEDGNILGH*
*KLEYNYNSHNVYIMADKQKNGIKVNFKIRHNIEDGSVQLADHYQQNTPIGDGPVLLPDNHYLSTQSALSKDPNEKR*
*DHMVLLEFVTAAGITLGMDELYK*

SEQ ID NO: 153
MTQFEGFTNLYQVSKTLRFELIPQGKILKHIQEQGFIEEDKARNDHYKELKPIIDRIYKTYADQCLQLVQLDWENLS
AAIDSYRKEKTEETRNALIEEQATYRNAIHDYFIGRIDNLTDAINKRHAEIYKGLFKAELENGKVLKQLGTVITTEH
ENALLRSEDKETTYFSGEYENRKNVESAEDISTAIPHRIVQDNFPKEKENCHIFTRLITAVPSLREHFENVKKAIGI
FVSTSIEEVESFPFYNQLLTQTQIDLYNQLLGGISREAGTEKIKGLNEVLNLAIQKNDETAHIIASLPHRFIPLEKQ
ILSDRNTLSFILEEEKSDEEVIQSECKYKILLRNENVLETAEALFNELNSIDLTHIFISHKKLETISSALCDHWDTL
RNALYERRISELTGKITKSAKEKVQRSLKHEDINLQEIISAAGKELSEAFKQKTSEILSHAHAALDQPLPTTLKKQE
EKEILKSQLDSLLGLYHLLDWFAVDESNEVDPEFSARLIGIKLEMEPSLSFYNKARNYATKKPYSVEKFKLNFQMPT
LASGWDVNKEKNNGAILFVKNGLYYLGIMPKQKGRYKALSFEPTEKTSEGFDKMYYDYFPDAAKMIPKCSTQLKAVT
AHFQTHTTPILLSNNFIEPLEITKEIYDLNNPEKEPKKFQTAYAKKTGDQKGYREALCKWIDETRDELSKYTKITSI
DLSSLRPSSQYKDLGEYYAELNPLLYHISFQRIAEKEIMDAVETGKLYLFQIYNKDFAKGHHGKPNLHTLYWTGLFS
PENLAKTSIKLNGQAELFYRPKSRMKRMAHRLGEKMLNKKLKDQKTPIPDTLYQELYDYVNHRLSHDLSDEARALLP
NVITKEVSHEIIKDRRFTSDKEFFHVPITLNYQAANSPSKENQRVNAYLKEHPETPIIGIDRGERNLIYITVIDSTG
KILEQRSLNTIQQFDYQKKLDNREKERVAARQAWSVVGTIKDLKQGYLSQVIHEIVDLMIHYQAVVVLENLNEGEKS
KRTGIAEKAVYQQFEKMLIDKLNCLVLKDYPAEKVGGVLNPYQLTDQFTSFAKMGTQSGELFYVPAPYTSKIDPLIG

TABLE V.4-continued

AsCas12a-Linker-mCherry Chimeras

FVDPFVWKTIKNHESRKHFLEGFDFLHYDVKTGDFILHFKMNRNLSFQRGLPGEMPAWDIVFEKNETQFDAKGTPFI
AGKRIVPVIENHRFTGRYRDLYPANELIALLEEKGIVERDGSNILPKLLENDDSHAIDTMVALIRSVLQMRNSNAAT
GEDYINSPVRDLNGVCEDSREQNPEWPMDADANGAYHIALKGQLLLNHLKESKDLKLQNGISNQDWLAYIQELRN
APAPAPAPAPAPAPAPAPA
*MVSKGEELFTGVVPILVELDGDVNGHKFSVSGEGEGDATYGKLTLKFICTTGKLPVPWPTLVTT*
*LTYGVQCFSRYPDHMKQHDFFKSAMPEGYVQERTIFFKDDGNYKTRAEVKFEGDTLVNRIELKGIDFKEDGNILGH*
*KLEYNYNSHNVYIMADKQKNGIKVNFKIRHNIEDGSVQLADHYQQNTPIGDGPVLLPDNHYLSTQSALSKDPNEKR*
*DHMVLLEFVTAAGITLGMDELYK*

SEQ ID NO: 154
MTQFEGFTNLYQVSKTLRFELIPQGKILKHIQEQGFIEEDKARNDHYKELKPIIDRIYKTYADQCLQLVQLDWENLS
AAIDSYRKEKTEETRNALIEEQATYRNAIHDYFIGRIDNLTDAINKRHAEIYKGLFKAELENGKVLKQLGTVITTEH
ENALLRSEDKETTYFSGEYENRKNVESAEDISTAIPHRIVQDNFPKEKENCHIFTRLITAVPSLREHFENVKKAIGI
FVSTSIEEVESFPPFYNQLLTQTQIDLYNQLLGGISREAGTEKIKGLNEVLNLAIQKNDETAHIIASLPHRFIPLEKQ
ILSDRNTLSFILEEEKSDEEVIQSECKYKILLRNENVLETAEALFNELNSIDLTHIFISHKKLETISSALCDHWDTL
RNALYERRISELTGKITKSAKEKVQRSLKHEDINLQEIISAAGKELSEAFKQKTSEILSHAHAALDQPLPTTLKKQE
EKEILKSQLDSLLGLYHLLDWFAVDESNEVDPEFSARLIGIKLEMEPSLSFYNKARNYATKKPYSVEKFKLNFQMPT
LASGWDVNKEKNNGAILFVKNGLYYLGIMPKQKGRYKALSFEPTEKTSEGFDKMYYDYFPDAAKMIPKCSTQLKAVT
AHFQTHTTPILLSNNFIEPLEITKEIYDLNNPEKEPKKFQTAYAKKTGDQKGYREALCKWIDETRDELSKYTKITSI
DLSSLRPSSQYKDLGEYYAELNPLLYHISFQRIAEKEIMDAVETGKLYLFQIYNKDFAKGHHGKPNLHTLYWTGLFS
PENLAKTSIKLNGQAELFYRPKSRMKRMAHRLGEKMLNKKLKDQKTPIPDTLYQELYDYVNHRLSHDLSDEARALLP
NVITKEVSHEIIKDRRFTSDKEFFHVPITLNYQAANSPSKENQRVNAYLKEHPETPIIGIDRGERNLIYITVIDSTG
KILEQRSLNTIQQFDYQKKLDNREKERVAARQAWSVVGTIKDLKQGYLSQVIHEIVDLMIHYQAVVVLENLNEGEKS
KRTGIAEKAVYQQFEKMLIDKLNCLVLKDYPAEKVGGVLNPYQLTDQFTSFAKMGTQSGELFYVPAPYTSKIDPLIG
FVDPFVWKTIKNHESRKHFLEGFDFLHYDVKTGDFILHFKMNRNLSFQRGLPGEMPAWDIVFEKNETQFDAKGTPFI
AGKRIVPVIENHRFTGRYRDLYPANELIALLEEKGIVERDGSNILPKLLENDDSHAIDTMVALIRSVLQMRNSNAAT
GEDYINSPVRDLNGVCEDSREQNPEWPMDADANGAYHIALKGQLLLNHLKESKDLKLQNGISNQDWLAYIQELRN
APAPAPAPAPAPAPAPAPA
*MVSKGEELFTGVVPILVELDGDVNGHKFSVSGEGEGDATYGKLTLKFICTTGKLPVPWPTLVTT*
*LTYGVQCFSRYPDHMKQHDFFKSAMPEGYVQERTIFFKDDGNYKTRAEVKFEGDTLVNRIELKGIDFKEDGNILGH*
*KLEYNYNSHNVYIMADKQKNGIKVNFKIRHNIEDGSVQLADHYQQNTPIGDGPVLLPDNHYLSTQSALSKDPNEKR*
*DHMVLLEFVTAAGITLGMDELYK*

SEQ ID NO: 155
MTQFEGFTNLYQVSKTLRFELIPQGKILKHIQEQGFIEEDKARNDHYKELKPIIDRIYKTYADQCLQLVQLDWENLS
AAIDSYRKEKTEETRNALIEEQATYRNAIHDYFIGRIDNLTDAINKRHAEIYKGLFKAELENGKVLKQLGTVITTEH
ENALLRSEDKETTYFSGEYENRKNVESAEDISTAIPHRIVQDNFPKEKENCHIFTRLITAVPSLREHFENVKKAIGI
FVSTSIEEVESFPPFYNQLLTQTQIDLYNQLLGGISREAGTEKIKGLNEVLNLAIQKNDETAHIIASLPHRFIPLEKQ
ILSDRNTLSFILEEEKSDEEVIQSECKYKILLRNENVLETAEALFNELNSIDLTHIFISHKKLETISSALCDHWDTL
RNALYERRISELTGKITKSAKEKVQRSLKHEDINLQEIISAAGKELSEAFKQKTSEILSHAHAALDQPLPTTLKKQE
EKEILKSQLDSLLGLYHLLDWFAVDESNEVDPEFSARLIGIKLEMEPSLSFYNKARNYATKKPYSVEKFKLNFQMPT
LASGWDVNKEKNNGAILFVKNGLYYLGIMPKQKGRYKALSFEPTEKTSEGFDKMYYDYFPDAAKMIPKCSTQLKAVT
AHFQTHTTPILLSNNFIEPLEITKEIYDLNNPEKEPKKFQTAYAKKTGDQKGYREALCKWIDETRDELSKYTKITSI
DLSSLRPSSQYKDLGEYYAELNPLLYHISFQRIAEKEIMDAVETGKLYLFQIYNKDFAKGHHGKPNLHTLYWTGLFS
PENLAKTSIKLNGQAELFYRPKSRMKRMAHRLGEKMLNKKLKDQKTPIPDTLYQELYDYVNHRLSHDLSDEARALLP
NVITKEVSHEIIKDRRFTSDKEFFHVPITLNYQAANSPSKENQRVNAYLKEHPETPIIGIDRGERNLIYITVIDSTG
KILEQRSLNTIQQFDYQKKLDNREKERVAARQAWSVVGTIKDLKQGYLSQVIHEIVDLMIHYQAVVVLENLNEGEKS
KRTGIAEKAVYQQFEKMLIDKLNCLVLKDYPAEKVGGVLNPYQLTDQFTSFAKMGTQSGELFYVPAPYTSKIDPLIG
FVDPFVWKTIKNHESRKHFLEGFDFLHYDVKTGDFILHFKMNRNLSFQRGLPGEMPAWDIVFEKNETQFDAKGTPFI
AGKRIVPVIENHRFTGRYRDLYPANELIALLEEKGIVERDGSNILPKLLENDDSHAIDTMVALIRSVLQMRNSNAAT
GEDYINSPVRDLNGVCEDSREQNPEWPMDADANGAYHIALKGQLLLNHLKESKDLKLQNGISNQDWLAYIQELRN
APAPAPAPAPAPAPAPAPA
*MVSKGEELFTGVVPILVELDGDVNGHKFSVSGEGEGDATYGKLTLKFICTTGKLPVPWPTLVTT*
*LTYGVQCFSRYPDHMKQHDFFKSAMPEGYVQERTIFFKDDGNYKTRAEVKFEGDTLVNRIELKGIDFKEDGNILGH*
*KLEYNYNSHNVYIMADKQKNGIKVNFKIRHNIEDGSVQLADHYQQNTPIGDGPVLLPDNHYLSTQSALSKDPNEKR*
*DHMVLLEFVTAAGITLGMDELYK*

SEQ ID NO: 156
MTQFEGFTNLYQVSKTLRFELIPQGKILKHIQEQGFIEEDKARNDHYKELKPIIDRIYKTYADQCLQLVQLDWENLS
AAIDSYRKEKTEETRNALIEEQATYRNAIHDYFIGRIDNLTDAINKRHAEIYKGLFKAELENGKVLKQLGTVITTEH
ENALLRSEDKETTYFSGEYENRKNVESAEDISTAIPHRIVQDNFPKEKENCHIFTRLITAVPSLREHFENVKKAIGI
FVSTSIEEVESFPPFYNQLLTQTQIDLYNQLLGGISREAGTEKIKGLNEVLNLAIQKNDETAHIIASLPHRFIPLEKQ
ILSDRNTLSFILEEEKSDEEVIQSECKYKILLRNENVLETAEALFNELNSIDLTHIFISHKKLETISSALCDHWDTL
RNALYERRISELTGKITKSAKEKVQRSLKHEDINLQEIISAAGKELSEAFKQKTSEILSHAHAALDQPLPTTLKKQE
EKEILKSQLDSLLGLYHLLDWFAVDESNEVDPEFSARLIGIKLEMEPSLSFYNKARNYATKKPYSVEKFKLNFQMPT
LASGWDVNKEKNNGAILFVKNGLYYLGIMPKQKGRYKALSFEPTEKTSEGFDKMYYDYFPDAAKMIPKCSTQLKAVT
AHFQTHTTPILLSNNFIEPLEITKEIYDLNNPEKEPKKFQTAYAKKTGDQKGYREALCKWIDETRDELSKYTKITSI
DLSSLRPSSQYKDLGEYYAELNPLLYHISFQRIAEKEIMDAVETGKLYLFQIYNKDFAKGHHGKPNLHTLYWTGLFS
PENLAKTSIKLNGQAELFYRPKSRMKRMAHRLGEKMLNKKLKDQKTPIPDTLYQELYDYVNHRLSHDLSDEARALLP
NVITKEVSHEIIKDRRFTSDKEFFHVPITLNYQAANSPSKENQRVNAYLKEHPETPIIGIDRGERNLIYITVIDSTG
KILEQRSLNTIQQFDYQKKLDNREKERVAARQAWSVVGTIKDLKQGYLSQVIHEIVDLMIHYQAVVVLENLNEGEKS
KRTGIAEKAVYQQFEKMLIDKLNCLVLKDYPAEKVGGVLNPYQLTDQFTSFAKMGTQSGELFYVPAPYTSKIDPLIG
FVDPFVWKTIKNHESRKHFLEGFDFLHYDVKTGDFILHFKMNRNLSFQRGLPGEMPAWDIVFEKNETQFDAKGTPFI
AGKRIVPVIENHRFTGRYRDLYPANELIALLEEKGIVERDGSNILPKLLENDDSHAIDTMVALIRSVLQMRNSNAAT
GEDYINSPVRDLNGVCEDSREQNPEWPMDADANGAYHIALKGQLLLNHLKESKDLKLQNGISNQDWLAYIQELRN
APAPAPAPAPAPAPAPAPAPA
*MVSKGEELFTGVVPILVELDGDVNGHKFSVSGEGEGDATYGKLTLKFICTTGKLPVPWPTLVTT*
*LTYGVQCFSRYPDHMKQHDFFKSAMPEGYVQERTIFFKDDGNYKTRAEVKFEGDTLVNRIELKGIDFKEDGNILGH*

TABLE V.4-continued

AsCas12a-Linker-mCherry Chimeras

*KLEYNYNSHNVYIMADKQKNGIKVNFKIRHNIEDGSVQLADHYQQNTPIGDGPVLLPDNHYLSTQSALSKDPNEKR*
*DHMVLLEFVTAAGITLGMDELYK*

SEQ ID NO: 157
MTQFEGFTNLYQVSKTLRFELIPQGKILKHIQEQGFIEEDKARNDHYKELKPIIDRIYKTYADQCLQLVQLDWENLS
AAIDSYRKEKTEETRNALIEEQATYRNAIHDYFIGRIDNLTDAINKRHAEIYKGLFKAELENGKVLKQLGTVITTEH
ENALLRSEDKETTYFSGEYENRKNVESAEDISTAIPHRIVQDNFPKEKENCHIFTRLITAVPSLREHFENVKKAIGI
FVSTSIEEVESFPPFYNQLLTQTQIDLYNQLLGGISREAGTEKIKGLNEVLNLAIQKNDETAHIIASLPHRFIPLEKQ
ILSDRNTLSFILEEEKSDEEVIQSECKYKILLRNENVLETAEALFNELNSIDLTHIFISHKKLETISSALCDHWDTL
RNALYERRISELTGKITKSAKEKVQRSLKHEDINLQEIISAAGKELSEAFKQKTSEILSHAHAALDQPLPTTLKKQE
EKEILKSQLDSLLGLYHLLDWFAVDESNEVDPEFSARLIGIKLEMEPSLSFYNKARNYATKKPYSVEKFKLNFQMPT
LASGWDVNKEKNNGAILFVKNGLYYLGIMPKQKGRYKALSFEPTEKTSEGFDKMYYDYFPDAAKMIPKCSTQLKAVT
AHFQTHTTPILLSNNFIEPLEITKEIYDLNNPEKEPKKFQTAYAKKTGDQKGYREALCKWIDETRDELSKYTKITSI
DLSSLRPSSQYKDLGEYYAELNPLLYHISFQRIAEKEIMDAVETGKLYLFQIYNKDFAKGHHGKPNLHTLYWTGLFS
PENLAKTSIKLNGQAELFYRPKSRMKRMAHRLGEKMLNKKLKDQKTPIPDTLYQELYDYVNHRLSHDLSDEARALLP
NVITKEVSHEIIKDRRFTSDKEFFHVPITLNYQAANSPSKENQRVNAYLKEHPETPIIGIDRGERNLIYITVIDSTG
KILEQRSLNTIQQFDYQKKLDNREKERVAARQAWSVVGTIKDLKQGYLSQVIHEIVDLMIHYQAVVVLENLNEGEKS
KRTGIAEKAVYQQFEKMLIDKLNCLVLKDYPAEKVGGVLNPYQLTDQFTSFAKMGTQSGELFYVPAPYTSKIDPLIG
FVDPFVWKTIKNHESRKHFLEGFDFLHYDVKTGDFILHFKMNRNLSFQRGLPGEMPAWDIVFEKNETQFDAKGTPFI
AGKRIVPVIENHRFTGRYRDLYPANELIALLEEKGIVERDGSNILPKLLENDDSHAIDTMVALIRSVLQMRNSNAAT
GEDYINSPVRDLNGVCEDSREQNPEWPMDADANGAYHIALKGQLLLNHLKESKDLKLQNGISNQDWLAYIQELRN
APAPAPAPAPAPAPAPAPAPAPAPA
*MVSKGEELFTGVVPILVELDGDVNGHKFSVSGEGEGDATYGKLTLKFICTTGKLPVPWPTLVTT*
*LTYGVQCFSRYPDHMKQHDFFKSAMPEGYVQERTIFFKDDGNYKTRAEVKFEGDTLVNRIELKGIDFKEDGNILGH*
*KLEYNYNSHNVYIMADKQKNGIKVNFKIRHNIEDGSVQLADHYQQNTPIGDGPVLLPDNHYLSTQSALSKDPNEKR*
*DHMVLLEFVTAAGITLGMDELYK*

SEQ ID NO: 158
MTQFEGFTNLYQVSKTLRFELIPQGKILKHIQEQGFIEEDKARNDHYKELKPIIDRIYKTYADQCLQLVQLDWENLS
AAIDSYRKEKTEETRNALIEEQATYRNAIHDYFIGRIDNLTDAINKRHAEIYKGLFKAELENGKVLKQLGTVITTEH
ENALLRSEDKETTYFSGEYENRKNVESAEDISTAIPHRIVQDNFPKEKENCHIFTRLITAVPSLREHFENVKKAIGI
FVSTSIEEVESFPPFYNQLLTQTQIDLYNQLLGGISREAGTEKIKGLNEVLNLAIQKNDETAHIIASLPHRFIPLEKQ
ILSDRNTLSFILEEEKSDEEVIQSECKYKILLRNENVLETAEALFNELNSIDLTHIFISHKKLETISSALCDHWDTL
RNALYERRISELTGKITKSAKEKVQRSLKHEDINLQEIISAAGKELSEAFKQKTSEILSHAHAALDQPLPTTLKKQE
EKEILKSQLDSLLGLYHLLDWFAVDESNEVDPEFSARLIGIKLEMEPSLSFYNKARNYATKKPYSVEKFKLNFQMPT
LASGWDVNKEKNNGAILFVKNGLYYLGIMPKQKGRYKALSFEPTEKTSEGFDKMYYDYFPDAAKMIPKCSTQLKAVT
AHFQTHTTPILLSNNFIEPLEITKEIYDLNNPEKEPKKFQTAYAKKTGDQKGYREALCKWIDETRDELSKYTKITSI
DLSSLRPSSQYKDLGEYYAELNPLLYHISFQRIAEKEIMDAVETGKLYLFQIYNKDFAKGHHGKPNLHTLYWTGLFS
PENLAKTSIKLNGQAELFYRPKSRMKRMAHRLGEKMLNKKLKDQKTPIPDTLYQELYDYVNHRLSHDLSDEARALLP
NVITKEVSHEIIKDRRFTSDKEFFHVPITLNYQAANSPSKENQRVNAYLKEHPETPIIGIDRGERNLIYITVIDSTG
KILEQRSLNTIQQFDYQKKLDNREKERVAARQAWSVVGTIKDLKQGYLSQVIHEIVDLMIHYQAVVVLENLNEGEKS
KRTGIAEKAVYQQFEKMLIDKLNCLVLKDYPAEKVGGVLNPYQLTDQFTSFAKMGTQSGELFYVPAPYTSKIDPLIG
FVDPFVWKTIKNHESRKHFLEGFDFLHYDVKTGDFILHFKMNRNLSFQRGLPGEMPAWDIVFEKNETQFDAKGTPFI
AGKRIVPVIENHRFTGRYRDLYPANELIALLEEKGIVFRDGSNILPKLLENDDSHAIDTMVALIRSVLQMRNSNAAT
GEDYINSPVRDLNGVCEDSREQNPEWPMDADANGAYHIALKGQLLLNHLKESKDLKLQNGISNQDWLAYIQELRN
APAPAPAPAPAPAPAPAPAPAPAPA
*MVSKGEELFTGVVPILVELDGDVNGHKFSVSGEGEGDATYGKLTLKFICTTGKLPVPWPTLVTT*
*LTYGVQCFSRYPDHMKQHDFFKSAMPEGYVQERTIFFKDDGNYKTRAEVKFEGDTLVNRIELKGIDFKEDGNILGH*
*KLEYNYNSHNVYIMADKQKNGIKVNFKIRHNIEDGSVQLADHYQQNTPIGDGPVLLPDNHYLSTQSALSKDPNEKR*
*DHMVLLEFVTAAGITLGMDELYK*

SEQ ID NO: 159
MTQFEGFTNLYQVSKTLRFELIPQGKTLKHIQEQGFIEEDKARNDHYKELKPIIDRIYKTYADQCLQLVQLDWENLS
AAIDSYRKEKTEETRNALIEEQATYRNAIHDYFIGRIDNLTDAINKRHAEIYKGLFKAELENGKVLKQLGTVITTEH
ENALLRSFDKETTYFSGEYENRKNVESAEDISTAIPHRIVQDNFPKEKENCHIFTRLITAVPSLREHFENVKKAIGI
FVSTSIEEVFSPPFYNQLLTQTQIDLYNQLLGGISREAGTEKIKGLNEVLNLAIQKNDETAHIIASLPHRFIPLFKQ
ILSDRNTLSFILEEFKSDEEVIQSFCKYKILLRNENVLETAEALFNELNSIDLTHIFISHKKLETISSALCDHWDTL
RNALYERRISELTGKITKSAKEKVQRSLKHEDINLQEIISAAGKELSEAFKQKTSEILSHAHAALDQPLPTTLKKQE
EKEILKSQLDSLLGLYHLLDWFAVDESNEVDPEFSARLTGIKLEMEPSLSFYNKARNYATKKPYSVEKFKLNFQMPT
LASGWDVNKEKNNGAILFVKNGLYYLGIMPKQKGRYKALSFEPTEKTSEGFDKMYYDYFPDAAKMIPKCSTQLKAVT
AHFQTHTTPILLSNNFIEPLEITKEIYDLNNPEKEPKKFQTAYAKKTGDQKGYREALCKWIDETRDELSKYTKTTSI
DLSSLRPSSQYKDLGEYYAELNPLLYHISFQRIAEKEIMDAVETGKLYLFQIYNKDFAKGHHGKPNLHTLYWTGLFS
PENLAKTSIKLNGQAELFYRPKSRMKRMAHRLGEKMLNKKLKDQKTPIPDTLYQELYDYVNHRLSHDLSDEARALLP
NVITKEVSHEIIKDRRFTSDKEFFHVPITLNYQAANSPSKFNQRVNAYLKEHPETPIIGIDRGERNLIYITVIDSTG
KILEQRSLNTIQQFDYQKKLDNREKERVAARQAWSVVGTIKDLKQGYLSQVIHEIVDLMIHYQAVVVLENLNEGEKS
KRTGIAEKAVYQQFEKMLIDKLNCLVLKDYPAEKVGGVLNPYQLTDQFTSFAKMGTQSGELFYVPAPYTSKIDPLTG
FVDPFVWKTIKNHESRKHFLEGFDFLHYDVKTGDFILHFKMNRNLSFQRGLPGEMPAWDIVFEKNETQFDAKGTPFI
AGKRIVPVIENHRFTGRYRDLYPANELIALLEEKGIVFRDGSNILPKLLENDDSHAIDTMVALIRSVLQMRNSNAAT
GEDYINSPVRDLNGVCEDSREQNPEWPMDADANGAYHIALKGQLLLNHLKESKDLKLQNGISNQDWLAYIQELRN
XP
*MVSKGEELFTGVVPILVELDGDVNGHKFSVSGEGEGDATYGKLTLKFICTTGKLPVPWPTLVTT*
*LTYGVQCFSRYPDHMKQHDFFKSAMPEGYVQERTIFFKDDGNYKTRAEVKFEGDTLVNRIELKGIDFKEDGNILGH*
*KLEYNYNSHNVYIMADKQKNGIKVNFKIRHNIEDGSVQLADHYQQNTPIGDGPVLLPDNHYLSTQSALSKDPNEKR*
*DHMVLLEFVTAAGITLGMDELYK*

SEQ ID NO: 160
MTQFEGFTNLYQVSKTLRFELIPQGKTLKHIQEQGFIEEDKARNDHYKELKPIIDRIYKTYADQCLQLVQLDWENLS
AAIDSYRKEKTEETRNALIEEQATYRNAIHDYFIGRIDNLTDAINKRHAEIYKGLFKAELENGKVLKQLGTVITTEH

TABLE V.4-continued

AsCas12a-Linker-mCherry Chimeras

ENALLRSFDKETTYFSGEYENRKNVESAEDISTAIPHRIVQDNFPKEKENCHIFTRLITAVPSLREHFENVKKAIGI
FVSTSIEEVFSPFYNQLLTQTQIDLYNQLLGGISREAGTEKLKGLNEVLNLAIQKNDETAHIIASLPHRFIPLFKQ
ILSDRNTLSFILEEFKSDEEVIQSFCKYKILLRNENVLETAEALFNELNSIDLTHIFISHKKLETISSALCDHWDTL
RNALYERRISELTGKITKSAKEKVQRSLKHEDINLQEIISAAGKELSEAFKQKTSEILSHAHAALDQPLPTTLKKQE
EKEILKSQLDSLLGLYHLLDWFAVDESNEVDPEFSARLTGIKLEMEPSLSFYNKARNYATKKPYSVEKFKLNFQMPT
LASGWDVNKENNGAILFVKNGLYYLGIMPKQKGRYKALSFEPTEKTSEGFDKMYYDYFPDAAKMIPKCSTQLKAVT
AHFQTHTTPILLSNNFIEPLEITKEIYDLNNPEKEPKKFQTAYAKKTGDQKGYREALCKWIDETRDELSKYTKTTSI
DLSSLRPSSQYKDLGEYYAELNPLLYHISFQRIAEKEIMDAVETGKLYLFQIYNKDFAKGHHGKPNLHTLYWTGLFS
PENLAKTSIKLNGQAELFYRPKSRMKRMAHRLGEKMLNKKLKDQKTPIPDTLYQELYDYVNHRLSHDLSDEARALLP
NVITKEVSHEIIKDRRFTSDKEFFHVPITLNYQAANSPSKFNQRVNAYLKEHPETPIIGIDRGERNLIYITVIDSTG
KILEQRSLNTIQQFDYQKKLDNREKERVAARQAWSVVGTIKDLKQGYLSQVIHEIVDLMIHYQAVVVLENLNEGEKS
KRTGIAEKAVYQQFEKMLIDKLNCLVLKDYPAEKVGGVLNPYQLTDQFTSFAKMGTQSGELFYVPAPYTSKIDPLTG
FVDPFVWKTIKNHESRKHFLEGFDFLHYDVKTGDFILHFKMNRNLSFQRGLPGEMPAWDIVFEKNETQFDAKGTPFI
AGKRIVPVIENHRFTGRYRDLYPANELIALLEEKGIVFRDGSNILPKLLENDDSHAIDTMVALIRSVLQMRNSNAAT
GEDYINSPVRDLNGVCEDSREQNPEWPMDADANGAYHIALKGQLLLNHLKESKDLKLQNGISNQDWLAYIQELRN
XPXP
*MVSKGEELFTGVVPILVELDGDVNGHKFSVSGEGEGDATYGKLTLKFICTTGKLPVPWPTLVTT*
*LTYGVQCFSRYPDHMKQHDFFKSAMPEGYVQERTIFFKDDGNYKTRAEVKFEGDTLVNRIELKGIDFKEDGNILGH*
*KLEYNYNSHNVYIMADKQKNGIKVNFKIRHNIEDGSVQLADHYQQNTPIGDGPVLLPDNHYLSTQSALSKDPNEKR*
*DHMVLLEFVTAAGITLGMDELYK*

SEQ ID NO: 161
MTQFEGFTNLYQVSKTLRFELIPQGKILKHIQEQGFIEEDKARNDHYKELKPIIDRIYKTYADQCLQLVQLDWENLS
AAIDSYRKEKTEETRNALIEEQATYRNAIHDYFIGRIDNLTDAINKRHAEIYKGLFKAELENGKVLKQLGTVITTEH
ENALLRSEDKETTYFSGEYENRKNVESAEDISTAIPHRIVQDNFPKEKENCHIFTRLITAVPSLREHFENVKKAIGI
FVSTSIEEVESPPFYNQLLTQTQIDLYNQLLGGISREAGTEKIKGLNEVLNLAIQKNDETAHIIASLPHRFIPLEKQ
ILSDRNTLSFILEEEKSDEEVIQSECKYKILLRNENVLETAEALFNELNSIDLTHIFISHKKLETISSALCDHWDTL
RNALYERRISELTGKITKSAKEKVQRSLKHEDINLQEIISAAGKELSEAFKQKTSEILSHAHAALDQPLPTTLKKQE
EKEILKSQLDSLLGLYHLLDWFAVDESNEVDPEFSARLGIKLEMEPSLSFYNKARNYATKKPYSVEKFKLNFQMPT
LASGWDVNKEKNNGAILFVKNGLYYLGIMPKQKGRYKALSFEPTEKTSEGFDKMYYDYFPDAAKMIPKCSTQLKAVT
AHFQTHTTPILLSNNFIEPLEITKEIYDLNNPEKEPKKFQTAYAKKTGDQKGYREALCKWIDETRDELSKYTKTTSI
DLSSLRPSSQYKDLGEYYAELNPLLYHISFQRIAEKEIMDAVETGKLYLFQIYNKDFAKGHHGKPNLHTLYWTGLFS
PENLAKTSIKLNGQAELFYRPKSRMKRMAHRLGEKMLNKKLKDQKTPIPDTLYQELYDYVNHRLSHDLSDEARALLP
NVITKEVSHEIIKDRRFTSDKEFFHVPITLNYQAANSPSKENQRVNAYLKEHPETPIIGIDRGERNLIYITVIDSTG
KILEQRSLNTIQQFDYQKKLDNREKERVAARQAWSVVGTIKDLKQGYLSQVIHEIVDLMIHYQAVVVLENLNEGEKS
KRTGIAEKAVYQQFEKMLIDKLNCLVLKDYPAEKVGGVLNPYQLTDQFTSFAKMGTQSGELFYVPAPYTSKIDPLIG
FVDPFVWKTIKNHESRKHFLEGFDFLHYDVKTGDFILHFKMNRNLSFQRGLPGEMPAWDIVFEKNETQFDAKGTPFI
AGKRIVPVIENHRFTGRYRDLYPANELIALLEEKGIVERDGSNILPKLLENDDSHAIDTMVALIRSVLQMRNSNAAT
GEDYINSPVRDLNGVCEDSREQNPEWPMDADANGAYHIALKGQLLLNHLKESKDLKLQNGISNQDWLAYIQELRN
XPXPXP
*MVSKGEELFTGVVPILVELDGDVNGHKFSVSGEGEGDATYGKLTLKFICTTGKLPVPWPTLVTT*
*LTYGVQCFSRYPDHMKQHDFFKSAMPEGYVQERTIFFKDDGNYKTRAEVKFEGDTLVNRIELKGIDFKEDGNILGH*
*KLEYNYNSHNVYIMADKQKNGIKVNFKIRHNIEDGSVQLADHYQQNTPIGDGPVLLPDNHYLSTQSALSKDPNEKR*
*DHMVLLEFVTAAGITLGMDELYK*

SEQ ID NO: 162
MTQFEGFTNLYQVSKTLRFELIPQGKILKHIQEQGFIEEDKARNDHYKELKPIIDRIYKTYADQCLQLVQLDWENLS
AAIDSYRKEKTEETRNALIEEQATYRNAIHDYFIGRIDNLTDAINKRHAEIYKGLFKAELENGKVLKQLGTVITTEH
ENALLRSEDKETTYFSGEYENRKNVESAEDISTAIPHRIVQDNFPKEKENCHIFTRLITAVPSLREHFENVKKAIGI
FVSTSIEEVESPPFYNQLLTQTQIDLYNQLLGGISREAGTEKIKGLNEVLNLAIQKNDETAHIIASLPHRFIPLEKQ
ILSDRNTLSFILEEEKSDEEVIQSECKYKILLRNENVLETAEALFNELNSIDLTHIFISHKKLETISSALCDHWDTL
RNALYERRISELTGKITKSAKEKVQRSLKHEDINLQEIISAAGKELSEAFKQKTSEILSHAHAALDQPLPTTLKKQE
EKEILKSQLDSLLGLYHLLDWFAVDESNEVDPEFSARLTGIKLEMEPSLSFYNKARNYATKKPYSVEKFKLNFQMPT
LASGWDVNKENNGAILFVKNGLYYLGIMPKQKGRYKALSFEPTEKTSEGFDKMYYDYFPDAAKMIPKCSTQLKAVT
AHFQTHTTPILLSNNFIEPLEITKEIYDLNNPEKEPKKFQTAYAKKTGDQKGYREALCKWIDETRDELSKYTKITSI
DLSSLRPSSQYKDLGEYYAELNPLLYHISFQRIAEKEIMDAVETGKLYLFQIYNKDFAKGHHGKPNLHTLYWTGLFS
PENLAKTSIKLNGQAELFYRPKSRMKRMAHRLGEKMLNKKLKDQKTPIPDTLYQELYDYVNHRLSHDLSDEARALLP
NVITKEVSHEIIKDRRFTSDKEFFHVPITLNYQAANSPSKENQRVNAYLKEHPETPIIGIDRGERNLIYITVIDSTG
KILEQRSLNTIQQFDYQKKLDNREKERVAARQAWSVVGTIKDLKQGYLSQVIHEIVDLMIHYQAVVVLENLNEGEKS
KRTGIAEKAVYQQFEKMLIDKLNCLVLKDYPAEKVGGVLNPYQLTDQFTSFAKMGTQSGELFYVPAPYTSKIDPLIG
FVDPFVWKTIKNHESRKHFLEGFDFLHYDVKTGDFILHFKMNRNLSFQRGLPGEMPAWDIVFEKNETQFDAKGTPFI
AGKRIVPVIENHRFTGRYRDLYPANELIALLEEKGIVERDGSNILPKLLENDDSHAIDTMVALIRSVLQMRNSNAAT
GEDYINSPVRDLNGVCEDSREQNPEWPMDADANGAYHIALKGQLLLNHLKESKDLKLQNGISNQDWLAYIQELRN
XPXPXP
*MVSKGEELFTGVVPILVELDGDVNGHKFSVSGEGEGDATYGKLTLKFICTTGKLPVPWPTLVTT*
*LTYGVQCFSRYPDHMKQHDFFKSAMPEGYVQERTIFFKDDGNYKTRAEVKFEGDTLVNRIELKGIDFKEDGNILGH*
*KLEYNYNSHNVYIMADKQKNGIKVNFKIRHNIEDGSVQLADHYQQNTPIGDGPVLLPDNHYLSTQSALSKDPNEKR*
*DHMVLLEFVTAAGITLGMDELYK*

SEQ ID NO: 163
MTQFEGFTNLYQVSKTLRFELIPQGKILKHIQEQGFIEEDKARNDHYKELKPIIDRIYKTYADQCLQLVQLDWENLS
AAIDSYRKEKTEETRNALIEEQATYRNAIHDYFIGRIDNLTDAINKRHAEIYKGLFKAELENGKVLKQLGTVITTEH
ENALLRSEDKETTYFSGEYENRKNVESAEDISTAIPHRIVQDNFPKEKENCHIFTRLITAVPSLREHFENVKKAIGI
FVSTSIEEVESPPFYNQLLTQTQIDLYNQLLGGISREAGTEKIKGLNEVLNLAIQKNDETAHIIASLPHRFIPLEKQ
ILSDRNTLSFILEEEKSDEEVIQSECKYKILLRNENVLETAEALFNELNSIDLTHIFISHKKLETISSALCDHWDTL
RNALYERRISELTGKITKSAKEKVQRSLKHEDINLQEIISAAGKELSEAFKQKTSEILSHAHAALDQPLPTTLKKQE
EKEILKSQLDSLLGLYHLLDWFAVDESNEVDPEFSARLGIKLEMEPSLSFYNKARNYATKKPYSVEKFKLNFQMPT
LASGWDVNKEKNNGAILFVKNGLYYLGIMPKQKGRYKALSFEPTEKTSEGFDKMYYDYFPDAAKMIPKCSTQLKAVT

TABLE V.4-continued

AsCas12a-Linker-mCherry Chimeras

AHFQTHTTPILLSNNFIEPLEITKEIYDLNNPEKEPKKFQTAYAKKTGDQKGYREALCKWIDETRDELSKYTKITSI
DLSSLRPSSQYKDLGEYYAELNPLLYHISFQRIAEKEIMDAVETGKLYLFQIYNKDFAKGHHGKPNLHTLYWTGLFS
PENLAKTSIKLNGQAELFYRPKSRMKRMAHRLGEKMLNKKLKDQKTPIPDTLYQELYDYVNHRLSHDLSDEARALLP
NVITKEVSHEIIKDRRFTSDKEFFHVPITLNYQAANSPSKENQRVNAYLKEHPETPIIGIDRGERNLIYITVIDSTG
KILEQRSLNTIQQFDYQKKLDNREKERVAARQAWSVVGTIKDLKQGYLSQVIHEIVDLMIHYQAVVVLENLNEGEKS
KRTGIAEKAVYQQFEKMLIDKLNCLVLKDYPAEKVGGVLNPYQLTDQFTSFAKMGTQSGELFYVPAPYTSKIDPLIG
FVDPFVWKTIKNHESRKHFLEGFDFLHYDVKTGDFILHFKMNRLSFQRGLPGEMPAWDIVFEKNETQFDAKGTPFI
AGKRIVPVIENHRFTGRYRDLYPANELIALLEEKGIVERDGSNILPKLLENDDSHAIDTMVALIRSVLQMRNSNAAT
GEDYINSPVRDLNGVCEDSREQNPEWPMDADANGAYHIALKGQLLLNHLKESKDLKLQNGISNQDWLAYIQELRN
XPXPXPXPXP
*MVSKGEELFTGVVPILVELDGDVNGHKFSVSGEGEGDATYGKLTLKFICTTGKLPVPWPTLVTT*
*LTYGVQCFSRYPDHMKQHDFFKSAMPEGYVQERTIFFKDDGNYKTRAEVKFEGDTLVNRIELKGIDFKEDGNILGH*
*KLEYNYNSHNVYIMADKQKNGIKVNFKIRHNIEDGSVQLADHYQQNTPIGDGPVLLPDNHYLSTQSALSKDPNEKR*
*DHMVLLEFVTAAGITLGMDELYK*

SEQ ID NO: 164
MTQFEGFTNLYQVSKTLRFELIPQGKILKHIQEQGFIEEDKARNDHYKELKPIIDRIYKTYADQCLQLVQLDWENLS
AAIDSYRKEKTEETRNALIEEQATYRNAIHDYFIGRIDNLTDAINKRHAEIYKGLFKAELENGKVLKQLGTVITTEH
ENALLRSEDKETTYFSGEYENRKNVESAEDISTAIPHRIVQDNFPKEKENCHIFTRLITAVPSLREHFENVKKAIGI
FVSTSIEEVESFPFYNQLLTQTQIDLYNQLLGGISREAGTEKIKGLNEVLNLAIQKNDETAHIIASLPHRFIPLEKQ
ILSDRNTLSFILEEEKSDEEVIQSECKYKILLRNENVLETAEALFNELNSIDLTHIFISHKKLETISSALCDHWDTL
RNALYERRISELTGKITKSAKEKVQRSLKHEDINLQEIISAAGKELSEAFKQKTSEILSHAHAALDQPLPTTLKKQE
EKEILKSQLDSLLGLYHLLDWFAVDESNEVDPEFSARLIGIKLEMEPSLSFYNKARNYATKKPYSVEKFKLNFQMPT
LASGWDVNKEKNNGAILFVKNGLYYLGIMPKQKGRYKALSFEPTEKTSEGFDKMYYDYFPDAAKMIPKCSTQLKAVT
AHFQTHTTPILLSNNFIEPLEITKEIYDLNNPEKEPKKFQTAYAKKTGDQKGYREALCKWIDETRDELSKYTKITSI
DLSSLRPSSQYKDLGEYYAELNPLLYHISFQRIAEKEIMDAVETGKLYLFQIYNKDFAKGHHGKPNLHTLYWTGLFS
PENLAKTSIKLNGQAELFYRPKSRMKRMAHRLGEKMLNKKLKDQKTPIPDTLYQELYDYVNHRLSHDLSDEARALLP
NVITKEVSHEIIKDRRFTSDKEFFHVPITLNYQAANSPSKENQRVNAYLKEHPETPIIGIDRGERNLIYITVIDSTG
KILEQRSLNTIQQFDYQKKLDNREKERVAARQAWSVVGTIKDLKQGYLSQVIHEIVDLMIHYQAVVVLENLNEGEKS
KRTGIAEKAVYQQFEKMLIDKLNCLVLKDYPAEKVGGVLNPYQLTDQFTSFAKMGTQSGELFYVPAPYTSKIDPLIG
FVDPFVWKTIKNHESRKHFLEGFDFLHYDVKTGDFILHFKMNRNLSFQRGLPGEMPAWDIVFEKNETQFDAKGTPFI
AGKRIVPVIENHRFTGRYRDLYPANELIALLEEKGIVERDGSNILPKLLENDDSHAIDTMVALIRSVLQMRNSNAAT
GEDYINSPVRDLNGVCEDSREQNPEWPMDADANGAYHIALKGQLLLNHLKESKDLKLQNGISNQDWLAYIQELRN
XPXPXPXPXP
*MVSKGEELFTGVVPILVELDGDVNGHKFSVSGEGEGDATYGKLTLKFICTTGKLPVPWPTLVTT*
*LTYGVQCFSRYPDHMKQHDFFKSAMPEGYVQERTIFFKDDGNYKTRAEVKFEGDTLVNRIELKGIDFKEDGNILGH*
*KLEYNYNSHNVYIMADKQKNGIKVNFKIRHNIEDGSVQLADHYQQNTPIGDGPVLLPDNHYLSTQSALSKDPNEKR*
*DHMVLLEFVTAAGITLGMDELYK*

SEQ ID NO: 165
MTQFEGFTNLYQVSKTLRFELIPQGKILKHIQEQGFIEEDKARNDHYKELKPIIDRIYKTYADQCLQLVQLDWENLS
AAIDSYRKEKTEETRNALIEEQATYRNAIHDYFIGRIDNLTDAINKRHAEIYKGLFKAELENGKVLKQLGTVITTEH
ENALLRSEDKETTYFSGEYENRKNVESAEDISTAIPHRIVQDNFPKEKENCHIFTRLITAVPSLREHFENVKKAIGI
FVSTSIEEVESFPFYNQLLTQTQIDLYNQLLGGISREAGTEKIKGLNEVLNLAIQKNDETAHIIASLPHRFIPLEKQ
ILSDRNTLSFILEEEKSDEEVIQSECKYKILLRNENVLETAEALFNELNSIDLTHIFISHKKLETISSALCDHWDTL
RNALYERRISELTGKITKSAKEKVQRSLKHEDINLQEIISAAGKELSEAFKQKTSEILSHAHAALDQPLPTTLKKQE
EKEILKSQLDSLLGLYHLLDWFAVDESNEVDPEFSARLIGIKLEMEPSLSFYNKARNYATKKPYSVEKFKLNFQMPT
LASGWDVNKEKNNGAILFVKNGLYYLGIMPKQKGRYKALSFEPTEKTSEGFDKMYYDYFPDAAKMIPKCSTQLKAVT
AHFQTHTTPILLSNNFIEPLEITKEIYDLNNPEKEPKKFQTAYAKKTGDQKGYREALCKWIDETRDELSKYTKITSI
DLSSLRPSSQYKDLGEYYAELNPLLYHISFQRIAEKEIMDAVETGKLYLFQIYNKDFAKGHHGKPNLHTLYWTGLFS
PENLAKTSIKLNGQAELFYRPKSRMKRMAHRLGEKMLNKKLKDQKTPIPDTLYQELYDYVNHRLSHDLSDEARALLP
NVITKEVSHEIIKDRRFTSDKEFFHVPITLNYQAANSPSKENQRVNAYLKEHPETPIIGIDRGERNLIYITVIDSTG
KILEQRSLNTIQQFDYQKKLDNREKERVAARQAWSVVGTIKDLKQGYLSQVIHEIVDLMIHYQAVVVLENLNEGEKS
KRTGIAEKAVYQQFEKMLIDKLNCLVLKDYPAEKVGGVLNPYQLTDQFTSFAKMGTQSGELFYVPAPYTSKIDPLIG
FVDPFVWKTIKNHESRKHFLEGFDFLHYDVKTGDFILHFKMNRNLSFQRGLPGEMPAWDIVFEKNETQFDAKGTPFI
AGKRIVPVIENHRFTGRYRDLYPANELIALLEEKGIVERDGSNILPKLLENDDSHAIDTMVALIRSVLQMRNSNAAT
GEDYINSPVRDLNGVCEDSREQNPEWPMDADANGAYHIALKGQLLLNHLKESKDLKLQNGISNQDWLAYIQELRN
XPXPXPXPXP
*MVSKGEELFTGVVPILVELDGDVNGHKFSVSGEGEGDATYGKLTLKFICTTGKLPVPWPTLVTT*
*LTYGVQCFSRYPDHMKQHDFFKSAMPEGYVQERTIFFKDDGNYKTRAEVKFEGDTLVNRIELKGIDFKEDGNILGH*
*KLEYNYNSHNVYIMADKQKNGIKVNFKIRHNIEDGSVQLADHYQQNTPIGDGPVLLPDNHYLSTQSALSKDPNEKR*
*DHMVLLEFVTAAGITLGMDELYK*

SEQ ID NO: 166
MTQFEGFTNLYQVSKTLRFELIPQGKILKHIQEQGFIEEDKARNDHYKELKPIIDRIYKTYADQCLQLVQLDWENLS
AAIDSYRKEKTEETRNALIEEQATYRNAIHDYFIGRIDNLTDAINKRHAEIYKGLFKAELENGKVLKQLGTVITTEH
ENALLRSEDKETTYFSGEYENRKNVESAEDISTAIPHRIVQDNFPKEKENCHIFTRLITAVPSLREHFENVKKAIGI
FVSTSIEEVESFPFYNQLLTQTQIDLYNQLLGGISREAGTEKIKGLNEVLNLAIQKNDETAHIIASLPHRFIPLEKQ
ILSDRNTLSFILEEEKSDEEVIQSECKYKILLRNENVLETAEALFNELNSIDLTHIFISHKKLETISSALCDHWDTL
RNALYERRISELTGKITKSAKEKVQRSLKHEDINLQEIISAAGKELSEAFKQKTSEILSHAHAALDQPLPTTLKKQE
EKEILKSQLDSLLGLYHLLDWFAVDESNEVDPEFSARLIGIKLEMEPSLSFYNKARNYATKKPYSVEKFKLNFQMPT
LASGWDVNKEKNNGAILFVKNGLYYLGIMPKQKGRYKALSFEPTEKTSEGFDKMYYDYFPDAAKMIPKCSTQLKAVT
AHFQTHTTPILLSNNFIEPLEITKEIYDLNNPEKEPKKFQTAYAKKTGDQKGYREALCKWIDETRDELSKYTKITSI
DLSSLRPSSQYKDLGEYYAELNPLLYHISFQRIAEKEIMDAVETGKLYLFQIYNKDFAKGHHGKPNLHTLYWTGLFS
PENLAKTSIKLNGQAELFYRPKSRMKRMAHRLGEKMLNKKLKDQKTPIPDTLYQELYDYVNHRLSHDLSDEARALLP
NVITKEVSHEIIKDRRFTSDKEFFHVPITLNYQAANSPSKENQRVNAYLKEHPETPIIGIDRGERNLIYITVIDSTG
KILEQRSLNTIQQFDYQKKLDNREKERVAARQAWSVVGTIKDLKQGYLSQVIHEIVDLMIHYQAVVVLENLNEGEKS
KRTGIAEKAVYQQFEKMLIDKLNCLVLKDYPAEKVGGVLNPYQLTDQFTSFAKMGTQSGELFYVPAPYTSKIDPLIG

TABLE V.4-continued

AsCas12a-Linker-mCherry Chimeras

```
FVDPFVWKTIKNHESRKHFLEGFDFLHYDVKTGDFILHFKMNRNLSFQRGLPGEMPAWDIVFEKNETQFDAKGTPFI
AGKRIVPVIENHRFTGRYRDLYPANELIALLEEKGIVERDGSNILPKLLENDDSHAIDTMVALIRSVLQMRNSNAAT
GEDYINSPVRDLNGVCEDSREQNPEWPMDADANGAYHIALKGQLLLNHLKESKDLKLQNGISNQDWLAYIQELRN
XPXPXPXPXPXPXPXP
```
***MVSKGEELFTGVVPILVELDGDVNGHKFSVSGEGEGDATYGKLTLKFICTTGKLPVPWPTLVTT
LTYGVQCFSRYPDHMKQHDFFKSAMPEGYVQERTIFFKDDGNYKTRAEVKFEGDTLVNRIELKGIDFKEDGNILGH
KLEYNYNSHNVYIMADKQKNGIKVNFKIRHNIEDGSVQLADHYQQNTPIGDGPVLLPDNHYLSTQSALSKDPNEKR
DHMVLLEFVTAAGITLGMDELYK***

SEQ ID NO: 167
```
MTQFEGFTNLYQVSKTLRFELIPQGKILKHIQEQGFIEEDKARNDHYKELKPIIDRIYKTYADQCLQLVQLDWENLS
AAIDSYRKEKTEETRNALIEEQATYRNAIHDYFIGRIDNLTDAINKRHAEIYKGLFKAELENGKVLKQLGTVITTEH
ENALLRSEDKETTYFSGEYENRKNVESAEDISTAIPHRIVQDNFPKEKENCHIFTRLITAVPSLREHFENVKKAIGI
FVSTSIEEVESFPPFYNQLLTQTQIDLYNQLLGGISREAGTEKIKGLNEVLNLAIQKNDETAHIIASLPHRFIPLEKQ
ILSDRNTLSFILEEEKSDEEVIQSECKYKILLRNENVLETAEALFNELNSIDLTHIFISHKKLETISSALCDHWDTL
RNALYERRISELTGKITKSAKEKVQRSLKHEDINLQEIISAAGKELSEAFKQKTSEILSHAHAALDQPLPTTLKKQE
EKEILKSQLDSLLGLYHLLDWFAVDESNEVDPEFSARLIGIKLEMEPSLSFYNKARNYATKKPYSVEKFKLNFQMPT
LASGWDVNKEKNNGAILFVKNGLYYLGIMPKQKGRYKALSFEPTEKTSEGFDKMYYDYFPDAAKMIPKCSTQLKAVT
AHFQTHTTPILLSNNFIEPLEITKEIYDLNNPEKEPKKFQTAYKKTGDQKGYREALCKFKIDETRDELSKYTKITSI
DLSSLRPSSQYKDLGEYYAELNPLLYHISFQRIAEKEIMDAVETGKLYLFQIYNKDFAKGHHGKPNLHTLYWTGLFS
PENLAKTSIKLNGQAELFYRPKSRMKRMAHRLGEKMLNKKLKDQKTPIPDTLYQELYDYVNHRLSHDLSDEARALLP
NVITKEVSHEIIKDRRFTSDKEFFHVPITLNYQAANSPSKENQRVNAYLKEHPETPIIGIDRGERNLIYITVIDSTG
KILEQRSLNTIQQFDYQKKLDNREKERVAARQAWSVVGTIKDLKQGYLSQVIHEIVDLMIHYQAVVVLENLNEGEKS
KRTGIAEKAVYQQFEKMLIDKLNCLVLKDYPAEKVGGVLNPYQLTDQFTSFAKMGTQSGELFYVPAPYTSKIDPLTG
FVDPFVWKTIKNHESRKHFLEGFDFLHYDVKTGDFILHFKMNRNLSFQRGLPGEMPAWDIVFEKNETQFDAKGTPFI
AGKRIVPVIENHRFTGRYRDLYPANELIALLEEKGIVFRDGSNILPKLLENDDSHAIDTMVALIRSVLQMRNSNAAT
GEDYINSPVRDLNGVCEDSREQNPEWPMDADANGAYHIALKGQLLLNHLKESKDLKLQNGISNQDWLAYIQELRN
XPXPXPXPXPXPXPXP
```
***MVSKGEELFTGVVPILVELDGDVNGHKFSVSGEGEGDATYGKLTLKFICTTGKLPVPWPTLVTT
LTYGVQCFSRYPDHMKQHDFFKSAMPEGYVQERTIFFKDDGNYKTRAEVKFEGDTLVNRIELKGIDFKEDGNILGH
KLEYNYNSHNVYIMADKQKNGIKVNFKIRHNIEDGSVQLADHYQQNTPIGDGPVLLPDNHYLSTQSALSKDPNEKR
DHMVLLEFVTAAGITLGMDELYK***

SEQ ID NO: 168
```
MTQFEGFTNLYQVSKTLRFELIPQGKTLKHIQEQGFIEEDKARNDHYKELKPIIDRIYKTYADQCLQLVQLDWENLS
AAIDSYRKEKTEETRNALIEEQATYRNAIHDYFIGRIDNLTDAINKRHAEIYKGLFKAELENGKVLKQLGTVITTEH
ENALLRSFDKETTYFSGEYENRKNVESAEDISTAIPHRIVQDNFPKEKENCHIFTRLITAVPSLREHFENVKKAIGI
FVSTSIEEVFSPPFYNQLLTQTQIDLYNQLLGGISREAGTEKIKGLNEVLNLAIQKNDETAHIIASLPHRFIPLFKQ
ILSDRNTLSFILEEFKSDEEVIQSFCKYKILLRNENVLETAEALFNELNSIDLTHIFISHKKLETISSALCDHWDTL
RNALYERRISELTGKITKSAKEKVQRSLKHEDINLQEIISAAGKELSEAFKQKTSEILSHAHAALDQPLPTTLKKQE
EKEILKSQLDSLLGLYHLLDWFAVDESNEVDPEFSARLTGIKLEMEPSLSFYNKARNYATKKPYSVEKFKLNFQMPT
LASGWDVNKEKNNGAILFVKNGLYYLGIMPKQKGRYKALSFEPTEKTSEGFDKMYYDYFPDAAKMIPKCSTQLKAVT
AHFQTHTTPILLSNNFIEPLEITKEIYDLNNPEKEPKKFQTAYKKTGDQKGYREALCKWIDETRDELSKYTKTTSI
DLSSLRPSSQYKDLGEYYAELNPLLYHISFQRIAEKEIMDAVETGKLYLFQIYNKDFAKGHHGKPNLHTLYWTGLFS
PENLAKTSIKLNGQAELFYRPKSRMKRMAHRLGEKMLNKKLKDQKTPIPDTLYQELYDYVNHRLSHDLSDEARALLP
NVITKEVSHEIIKDRRFTSDKEFFHVPITLNYQAANSPSKFNQRVNAYLKEHPETPIIGIDRGERNLIYITVIDSTG
KILEQRSLNTIQQFDYQKKLDNREKERVAARQAWSVVGTIKDLKQGYLSQVIHEIVDLMIHYQAVVVLENLNEGEKS
KRTGIAEKAVYQQFEKMLIDKLNCLVLKDYPAEKVGGVLNPYQLTDQFTSFAKMGTQSGELFYVPAPYTSKIDPLTG
FVDPFVWKTIKNHESRKHFLEGFDFLHYDVKTGDFILHFKMNRNLSFQRGLPGEMPAWDIVFEKNETQFDAKGTPFI
AGKRIVPVIENHRFTGRYRDLYPANELIALLEEKGIVFRDGSNILPKLLENDDSHAIDTMVALIRSVLQMRNSNAAT
GEDYINSPVRDLNGVCEDSREQNPEWPMDADANGAYHIALKGQLLLNHLKESKDLKLQNGISNQDWLAYIQELRN
XPXPXPXPXPXPXPXP
```
***MVSKGEELFTGVVPILVELDGDVNGHKFSVSGEGEGDATYGKLTLKFICTTGKLPVPWPTLVTT
LTYGVQCFSRYPDHMKQHDFFKSAMPEGYVQERTIFFKDDGNYKTRAEVKFEGDTLVNRIELKGIDFKEDGNILGH
KLEYNYNSHNVYIMADKQKNGIKVNFKIRHNIEDGSVQLADHYQQNTPIGDGPVLLPDNHYLSTQSALSKDPNEKR
DHMVLLEFVTAAGITLGMDELYK***

SEQ ID NO: 169
```
MTQFEGFTNLYQVSKTLRFELIPQGKTLKHIQEQGFIEEDKARNDHYKELKPIIDRIYKTYADQCLQLVQLDWENLS
AAIDSYRKEKTEETRNALIEEQATYRNAIHDYFIGRIDNLTDAINKRHAEIYKGLFKAELENGKVLKQLGTVITTEH
ENALLRSFDKETTYFSGEYENRKNVESAEDISTAIPHRIVQDNFPKEKENCHIFTRLITAVPSLREHFENVKKAIGI
FVSTSIEEVFSPPFYNQLLTQTQIDLYNQLLGGISREAGTEKIKGLNEVLNLAIQKNDETAHIIASLPHRFIPLFKQ
ILSDRNTLSFILEEFKSDEEVIQSFCKYKILLRNENVLETAEALFNELNSIDLTHIFISHKKLETISSALCDHWDTL
RNALYERRISELTGKITKSAKEKVQRSLKHEDINLQEIISAAGKELSEAFKQKTSEILSHAHAALDQPLPTTLKKQE
EKEILKSQLDSLLGLYHLLDWFAVDESNEVDPEFSARLTGIKLEMEPSLSFYNKARNYATKKPYSVEKFKLNFQMPT
LASGWDVNKEKNNGAILFVKNGLYYLGIMPKQKGRYKALSFEPTEKTSEGFDKMYYDYFPDAAKMIPKCSTQLKAVT
AHFQTHTTPILLSNNFIEPLEITKEIYDLNNPEKEPKKFQTAYKKTGDQKGYREALCKWIDETRDELSKYTKTTSI
DLSSLRPSSQYKDLGEYYAELNPLLYHISFQRIAEKEIMDAVETGKLYLFQIYNKDFAKGHHGKPNLHTLYWTGLFS
PENLAKTSIKLNGQAELFYRPKSRMKRMAHRLGEKMLNKKLKDQKTPIPDTLYQELYDYVNHRLSHDLSDEARALLP
NVITKEVSHEIIKDRRFTSDKEFFHVPITLNYQAANSPSKFNQRVNAYLKEHPETPIIGIDRGERNLIYITVIDSTG
KILEQRSLNTIQQFDYQKKLDNREKERVAARQAWSVVGTIKDLKQGYLSQVIHEIVDLMIHYQAVVVLENLNEGEKS
KRTGIAEKAVYQQFEKMLIDKLNCLVLKDYPAEKVGGVLNPYQLTDQFTSFAKMGTQSGELFYVPAPYTSKIDPLTG
FVDPFVWKTIKNHESRKHFLEGFDFLHYDVKTGDFILHFKMNRNLSFQRGLPGEMPAWDIVFEKNETQFDAKGTPFI
AGKRIVPVIENHRFTGRYRDLYPANELIALLEEKGIVFRDGSNILPKLLENDDSHAIDTMVALIRSVLQMRNSNAAT
GEDYINSPVRDLNGVCEDSREQNPEWPMDADANGAYHIALKGQLLLNHLKESKDLKLQNGISNQDWLAYIQELRN
XPXPXPXPXPXPXPXPXP
```
***MVSKGEELFTGVVPILVELDGDVNGHKFSVSGEGEGDATYGKLTLKFICTTGKLPVPWPTLVTT
LTYGVQCFSRYPDHMKQHDFFKSAMPEGYVQERTIFFKDDGNYKTRAEVKFEGDTLVNRIELKGIDFKEDGNILGH***

TABLE V.4-continued

AsCas12a-Linker-mCherry Chimeras

*KLEYNYNSHNVYIMADKQKNGIKVNFKIRHNIEDGSVQLADHYQQNTPIGDGPVLLPDNHYLSTQSALSKDPNEKR*
*DHMVLLEFVTAAGITLGMDELYK*

SEQ ID NO: 170
MTQFEGFTNLYQVSKTLRFELIPQGKILKHIQEQGFIEEDKARNDHYKELKPIIDRIYKTYADQCLQLVQLDWENLS
AAIDSYRKEKTEETRNALIEEQATYRNAIHDYFIGRIDNLTDAINKRHAEIYKGLFKAELENGKVLKQLGTVITTEH
ENALLRSEDKETTYFSGEYENRKNVESAEDISTAIPHRIVQDNFPKEKENCHIFTRLITAVPSLREHFENVKKAIGI
FVSTSIEEVESPPFYNQLLTQTQIDLYNQLLGGISREAGTEKIKGLNEVLNLAIQKNDETAHIIASLPHRFIPLEKQ
ILSDRNTLSFILEEEKSDEEVIQSECKYKILLRNENVLETAEALFNELNSIDLTHIFISHKKLETISSALCDHWDTL
RNALYERRISELTGKITKSAKEKVQRSLKHEDINLQEIISAAGKELSEAFKQKTSEILSHAHAALDQPLPTTLKKQE
EKEILKSQLDSLLGLYHLLDWFAVDESNEVDPEFSARLIGIKLEMEPSLSFYNKARNYATKKPYSVEKFKLNFQMPT
LASGWDVNKEKNNGAILFVKNGLYYLGIMPKQKGRYKALSFEPTEKTSEGFDKMYYDYFPDAAKMIPKCSTQLKAVT
AHFQTHTTPILLSNNFIEPLEITKEIYDLNNPEKEPKKFQTAYAKKTGDQKGYREALCKWIDETRDELSKYTKITSI
DLSSLRPSSQYKDLGEYYAELNPLLYHISFQRIAEKEIMDAVETGKLYLFQIYNKDFAKGHHGKPNLHTLYWTGLFS
PENLAKTSIKLNGQAELFYRPKSRMKRMAHRLGEKMLNKKLKDQKTPIPDTLYQELYDYVNHRLSHDLSDEARALLP
NVITKEVSHEIIKDRRFTSDKEFFHVPITLNYQAANSPSKENQRVNAYLKEHPETPIIGIDRGERNLIYITVIDSTG
KILEQRSLNTIQQFDYQKKLDNREKERVAARQAWSVVGTIKDLKQGYLSQVIHEIVDLMIHYQAVVVLENLNEGEKS
KRTGIAEKAVYQQFEKMLIDKLNCLVLKDYPAEKVGGVLNPYQLTDQFTSFAKMGTQSGELFYVPAPYTSKIDPLIG
FVDPFVWKTIKNHESRKHFLEGFDFLHYDVKTGDFILHFKMNRNLSFQRGLPGEMPAWDIVFEKNETQFDAKGTPFI
AGKRIVPVIENHRFTGRYRDLYPANELIALLEEKGIVERDGSNILPKLLENDDSHAIDTMVALIRSVLQMRNSNAAT
GEDYINSPVRDLNGVCEDSREQNPEWPMDADANGAYHIALKGQLLLNHLKESKDLKLQNGISNQDWLAYIQELRN
XPXPXPXPXPXPXPXPXPXPXPXP
*MVSKGEELFTGVVPILVELDGDVNGHKFSVSGEGEGDATYGKLTLKFICTTGKLPVPWPTLVTT*
*LTYGVQCFSRYPDHMKQHDFFKSAMPEGYVQERTIFFKDDGNYKTRAEVKFEGDTLVNRIELKGIDFKEDGNILGH*
*KLEYNYNSHNVYIMADKQKNGIKVNFKIRHNIEDGSVQLADHYQQNTPIGDGPVLLPDNHYLSTQSALSKDPNEKR*
*DHMVLLEFVTAAGITLGMDELYK*

SEQ ID NO: 171
MTQFEGFTNLYQVSKTLRFELIPQGKILKHIQEQGFIEEDKARNDHYKELKPIIDRIYKTYADQCLQLVQLDWENLS
AAIDSYRKEKTEETRNALIEEQATYRNAIHDYFIGRIDNLTDAINKRHAEIYKGLFKAELENGKVLKQLGTVITTEH
ENALLRSEDKETTYFSGEYENRKNVESAEDISTAIPHRIVQDNFPKEKENCHIFTRLITAVPSLREHFENVKKAIGI
FVSTSIEEVESPPFYNQLLTQTQIDLYNQLLGGISREAGTEKIKGLNEVLNLAIQKNDETAHIIASLPHRFIPLEKQ
ILSDRNTLSFILEEEKSDEEVIQSECKYKILLRNENVLETAEALFNELNSIDLTHIFISHKKLETISSALCDHWDTL
RNALYERRISELTGKITKSAKEKVQRSLKHEDINLQEIISAAGKELSEAFKQKTSEILSHAHAALDQPLPTTLKKQE
EKEILKSQLDSLLGLYHLLDWFAVDESNEVDPEFSARLIGIKLEMEPSLSFYNKARNYATKKPYSVEKFKLNFQMPT
LASGWDVNKEKNNGAILFVKNGLYYLGIMPKQKGRYKALSFEPTEKTSEGFDKMYYDYFPDAAKMIPKCSTQLKAVT
AHFQTHTTPILLSNNFIEPLEITKEIYDLNNPEKEPKKFQTAYAKKTGDQKGYREALCKWIDETRDELSKYTKITSI
DLSSLRPSSQYKDLGEYYAELNPLLYHISFQRIAEKEIMDAVETGKLYLFQIYNKDFAKGHHGKPNLHTLYWTGLFS
PENLAKTSIKLNGQAELFYRPKSRMKRMAHRLGEKMLNKKLKDQKTPIPDTLYQELYDYVNHRLSHDLSDEARALLP
NVITKEVSHEIIKDRRFTSDKEFFHVPITLNYQAANSPSKENQRVNAYLKEHPETPIIGIDRGERNLIYITVIDSTG
KILEQRSLNTIQQFDYQKKLDNREKERVAARQAWSVVGTIKDLKQGYLSQVIHEIVDLMIHYQAVVVLENLNEGEKS
KRTGIAEKAVYQQFEKMLIDKLNCLVLKDYPAEKVGGVLNPYQLTDQFTSFAKMGTQSGELFYVPAPYTSKIDPLIG
FVDPFVWKTIKNHESRKHFLEGFDFLHYDVKTGDFILHFKMNRNLSFQRGLPGEMPAWDIVFEKNETQFDAKGTPFI
AGKRIVPVIENHRFTGRYRDLYPANELIALLEEKGIVERDGSNILPKLLENDDSHAIDTMVALIRSVLQMRNSNAAT
GEDYINSPVRDLNGVCEDSREQNPEWPMDADANGAYHIALKGQLLLNHLKESKDLKLQNGISNQDWLAYIQELRN
XPXPXPXPXPXPXPXPXPXPXPXP
*MVSKGEELFTGVVPILVELDGDVNGHKFSVSGEGEGDATYGKLTLKFICTTGKLPVPWPTLVTT*
*LTYGVQCFSRYPDHMKQHDFFKSAMPEGYVQERTIFFKDDGNYKTRAEVKFEGDTLVNRIELKGIDFKEDGNILGH*
*KLEYNYNSHNVYIMADKQKNGIKVNFKIRHNIEDGSVQLADHYQQNTPIGDGPVLLPDNHYLSTQSALSKDPNEKR*
*DHMVLLEFVTAAGITLGMDELYK*

SEQ ID NO: 172
MTQFEGFTNLYQVSKTLRFELIPQGKILKHIQEQGFIEEDKARNDHYKELKPIIDRIYKTYADQCLQLVQLDWENLS
AAIDSYRKEKTEETRNALIEEQATYRNAIHDYFIGRIDNLTDAINKRHAEIYKGLFKAELENGKVLKQLGTVITTEH
ENALLRSEDKETTYFSGEYENRKNVESAEDISTAIPHRIVQDNFPKEKENCHIFTRLITAVPSLREHFENVKKAIGI
FVSTSIEEVESPPFYNQLLTQTQIDLYNQLLGGISREAGTEKIKGLNEVLNLAIQKNDETAHIIASLPHRFIPLEKQ
ILSDRNTLSFILEEEKSDEEVIQSECKYKILLRNENVLETAEALFNELNSIDLTHIFISHKKLETISSALCDHWDTL
RNALYERRISELTGKITKSAKEKVQRSLKHEDINLQEIISAAGKELSEAFKQKTSEILSHAHAALDQPLPTTLKKQE
EKEILKSQLDSLLGLYHLLDWFAVDESNEVDPEFSARLIGIKLEMEPSLSFYNKARNYATKKPYSVEKFKLNFQMPT
LASGWDVNKEKNNGAILFVKNGLYYLGIMPKQKGRYKALSFEPTEKTSEGFDKMYYDYFPDAAKMIPKCSTQLKAVT
AHFQTHTTPILLSNNFIEPLEITKEIYDLNNPEKEPKKFQTAYAKKTGDQKGYREALCKWIDETRDELSKYTKITSI
DLSSLRPSSQYKDLGEYYAELNPLLYHISFQRIAEKEIMDAVETGKLYLFQIYNKDFAKGHHGKPNLHTLYWTGLFS
PENLAKTSIKLNGQAELFYRPKSRMKRMAHRLGEKMLNKKLKDQKTPIPDTLYQELYDYVNHRLSHDLSDEARALLP
NVITKEVSHEIIKDRRFTSDKEFFHVPITLNYQAANSPSKENQRVNAYLKEHPETPIIGIDRGERNLIYITVIDSTG
KILEQRSLNTIQQFDYQKKLDNREKERVAARQAWSVVGTIKDLKQGYLSQVIHEIVDLMIHYQAVVVLENLNEGEKS
KRTGIAEKAVYQQFEKMLIDKLNCLVLKDYPAEKVGGVLNPYQLTDQFTSFAKMGTQSGELFYVPAPYTSKIDPLIG
FVDPFVWKTIKNHESRKHFLEGFDFLHYDVKTGDFILHFKMNRNLSFQRGLPGEMPAWDIVFEKNETQFDAKGTPFI
AGKRIVPVIENHRFTGRYRDLYPANELIALLEEKGIVERDGSNILPKLLENDDSHAIDTMVALIRSVLQMRNSNAAT
GEDYINSPVRDLNGVCEDSREQNPEWPMDADANGAYHIALKGQLLLNHLKESKDLKLQNGISNQDWLAYIQELRN
XPXPXPXPXPXPXPXPXPXPXPXP
*MVSKGEELFTGVVPILVELDGDVNGHKFSVSGEGEGDATYGKLTLKFICTTGKLPVPWPTLVTT*
*LTYGVQCFSRYPDHMKQHDFFKSAMPEGYVQERTIFFKDDGNYKTRAEVKFEGDTLVNRIELKGIDFKEDGNILGH*
*KLEYNYNSHNVYIMADKQKNGIKVNFKIRHNIEDGSVQLADHYQQNTPIGDGPVLLPDNHYLSTQSALSKDPNEKR*
*DHMVLLEFVTAAGITLGMDELYK*

SEQ ID NO: 173
MTQFEGFTNLYQVSKTLRFELIPQGKILKHIQEQGFIEEDKARNDHYKELKPIIDRIYKTYADQCLQLVQLDWENLS
AAIDSYRKEKTEETRNALIEEQATYRNAIHDYFIGRIDNLTDAINKRHAEIYKGLFKAELENGKVLKQLGTVITTEH

TABLE V.4-continued

AsCas12a-Linker-mCherry Chimeras

ENALLRSEDKETTYFSGEYENRKNVESAEDISTAIPHRIVQDNFPKEKENCHIFTRLITAVPSLREHFENVKKAIGI
FVSTSIEEVESFPFYNQLLTQTQIDLYNQLLGGISREAGTEKIKGLNEVLNLAIQKNDETAHIIASLPHRFIPLEKQ
ILSDRNTLSFILEEEKSDEEVIQSECKYKILLRNENVLETAEALFNELNSIDLTHIFISHKKLETISSALCDHWDTL
RNALYERRISELTGKITKSAKEKVQRSLKHEDINLQEIISAAGKELSEAFKQKTSEILSHAHAALDQPLPTTLKKQE
EKEILKSQLDSLLGLYHLLDWFAVDESNEVDPEFSARLIGIKLEMEPSLSFYNKARNYATKKPYSVEKFKLNFQMPT
LASGWDVNKEKNNGAILFVKNGLYYLGIMPKQKGRYKALSFEPTEKTSEGFDKMYYDYFPDAAKMIPKCSTQLKAVT
AHFQTHTTPILLSNNFIEPLEITKEIYDLNNPEKEPKKFQTAYAKKTGDQKGYREALCKWIDETRDELSKYTKITSI
DLSSLRPSSQYKDLGEYYAELNPLLYHISFQRIAEKEIMDAVETGKLYLFQIYNKDFAKGHHGKPNLHTLYWTGLFS
PENLAKTSIKLNGQAELFYRPKSRMKRMAHRLGEKMLNKKLKDQKTPIPDTLYQELYDYVNHRLSHDLSDEARALLP
NVITKEVSHEIIKDRRFTSDKEFFHVPITLNYQAANSPSKENQRVNAYLKEHPETPIIGIDRGERNLIYITVIDSTG
KILEQRSLNTIQQFDYQKKLDNREKERVAARQAWSVVGTIKDLKQGYLSQVIHEIVDLMIHYQAVVVLENLNEGEKS
KRTGIAEKAVYQQFEKMLIDKLNCLVLKDYPAEKVGGVLNPYQLTDQFTSFAKMGTQSGELFYVPAPYTSKIDPLIG
FVDPFVWKTIKNHESRKHFLEGFDFLHYDVKTGDFILHFKMNRNLSFQRGLPGEMPAWDIVFEKNETQFDAKGTPFI
AGKRIVPVIENHRFTGRYRDLYPANELIALLEEKGIVERDGSNILPKLLENDDSHAIDTMVALIRSVLQMRNSNAAT
GEDYINSPVRDLNGVCEDSREQNPEWPMDADANGAYHIALKGQLLLNHLKESKDLKLQNGISNQDWLAYIQELRN
GGGGSEAAAKGGGGS
*MVSKGEELFTGVVPILVELDGDVNGHKFSVSGEGEGDATYGKLTLKFICTTGKLPVPWPTLVTT*
*LTYGVQCFSRYPDHMKQHDFFKSAMPEGYVQERTIFFKDDGNYKTRAEVKFEGDTLVNRIELKGIDFKEDGNILGH*
*KLEYNYNSHNVYIMADKQKNGIKVNFKIRHNIEDGSVQLADHYQQNTPIGDGPVLLPDNHYLSTQSALSKDPNEKR*
*DHMVLLEFVTAAGITLGMDELYK*

Table V.5 provides chimera fusion proteins between LbCas12a amino acid sequences, linker amino acid sequences (underlined), and eGFP amino acid sequences (bolded, italicized).

TABLE V.5

LbCas12a-Linker-eGFP Chimeras

SEQ ID NO: 174
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQKLPFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYELHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
GSAGSAAGSGEF
*MVSKGEELFTGVVPILVELDGDVNGHKFSVSGEGEGDATYGKLTLKFICTTGKLPVPWPTLVTT*
*LTYGVQCFSRYPDHMKQHDFFKSAMPEGYVQERTIFFKDDGNYKTRAEVKFEGDTLVNRIELKGIDFKEDGNILGH*
*KLEYNYNSHNVYIMADKQKNGIKVNFKIRHNIEDGSVQLADHYQQNTPIGDGPVLLPDNHYLSTQSALSKDPNEKR*
*DHMVLLEFVTAAGITLGMDELYK*

SEQ ID NO: 175
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQKLPFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYELHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
GGGGSGGGGSGGGGSGGGGS
*MVSKGEELFTGVVPILVELDGDVNGHKFSVSGEGEGDATYGKLTLKFICTTGKLPVPWPTLVTT*
*LTYGVQCFSRYPDHMKQHDFFKSAMPEGYVQERTIFFKDDGNYKTRAEVKFEGDTLVNRIELKGIDFKEDGNILGH*
*KLEYNYNSHNVYIMADKQKNGIKVNFKIRHNIEDGSVQLADHYQQNTPIGDGPVLLPDNHYLSTQSALSKDPNEKR*
*DHMVLLEFVTAAGITLGMDELYK*

TABLE V.5-continued

LbCas12a-Linker-eGFP Chimeras

SEQ ID NO: 176
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYELHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
AEAAAKEAAAKEAAAKEAAAKA
*MVSKGEELFTGVVPILVELDGDVNGHKFSVSGEGEGDATYGKLTLKFICTTGKLPVPWPTLVTT
LTYGVQCFSRYPDHMKQHDFFKSAMPEGYVQERTIFFKDDGNYKTRAEVKFEGDTLVNRIELKGIDFKEDGNILGH
KLEYNYNSHNVYIMADKQKNGIKVNFKIRHNIEDGSVQLADHYQQNTPIGDGPVLLPDNHYLSTQSALSKDPNEKR
DHMVLLEFVTAAGITLGMDELYK*

SEQ ID NO: 177
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYELHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
AEAAAKEAAAKEAAAKALEAEAAAKEAAAKEAAAKEAAAKA
*MVSKGEELFTGVVPILVELDGDVNGHKFSVSGEGEGDATYGKLTLKFICTTGKLPVPWPTLVTT
LTYGVQCFSRYPDHMKQHDFFKSAMPEGYVQERTIFFKDDGNYKTRAEVKFEGDTLVNRIELKGIDFKEDGNILGH
KLEYNYNSHNVYIMADKQKNGIKVNFKIRHNIEDGSVQLADHYQQNTPIGDGPVLLPDNHYLSTQSALSKDPNEKR
DHMVLLEFVTAAGITLGMDELYK*

SEQ ID NO: 178
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYELHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
LEAEAAAKEAAAKEAAAKALEAEAAAKEAAAKEAAAKALE
*MVSKGEELFTGVVPILVELDGDVNGHKFSVSGEGEGDATYGKLTLKFICTTGKLPVPWPTLVTT
LTYGVQCFSRYPDHMKQHDFFKSAMPEGYVQERTIFFKDDGNYKTRAEVKFEGDTLVNRIELKGIDFKEDGNILGH
KLEYNYNSHNVYIMADKQKNGIKVNFKIRHNIEDGSVQLADHYQQNTPIGDGPVLLPDNHYLSTQSALSKDPNEKR
DHMVLLEFVTAAGITLGMDELYK*

SEQ ID NO: 179
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE

TABLE V.5-continued

LbCas12a-Linker-eGFP Chimeras

TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYELHIPIAINKCPKNIFKINTEVRVLLKHDDNPYVIGIDRGERNLLYIVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
APA
*MVSKGEELFTGVVPILVELDGDVNGHKFSVSGEGEGDATYGKLTLKFICTTGKLPVPWPTLVTT
LTYGVQCFSRYPDHMKQHDFFKSAMPEGYVQERTIFFKDDGNYKTRAEVKFEGDTLVNRIELKGIDFKEDGNILGH
KLEYNYNSHNVYIMADKQKNGIKVNFKIRHNIEDGSVQLADHYQQNTPIGDGPVLLPDNHYLSTQSALSKDPNEKR
DHMVLLEFVTAAGITLGMDELYK*

SEQ ID NO: 180
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDFKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYELHIPIAINKCPKNIFKINTEVRVLLKHDDNPYVIGIDRGERNLLYIVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
APAPA
*MVSKGEELFTGVVPILVELDGDVNGHKFSVSGEGEGDATYGKLTLKFICTTGKLPVPWPTLVTT
LTYGVQCFSRYPDHMKQHDFFKSAMPEGYVQERTIFFKDDGNYKTRAEVKFEGDTLVNRIELKGIDFKEDGNILGH
KLEYNYNSHNVYIMADKQKNGIKVNFKIRHNIEDGSVQLADHYQQNTPIGDGPVLLPDNHYLSTQSALSKDPNEKR
DHMVLLEFVTAAGITLGMDELYK*

SEQ ID NO: 181
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDFKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYELHIPIAINKCPKNIFKINTEVRVLLKHDDNPYVIGIDRGERNLLYIVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
APAPAPA
*MVSKGEELFTGVVPILVELDGDVNGHKFSVSGEGEGDATYGKLTLKFICTTGKLPVPWPTLVTT
LTYGVQCFSRYPDHMKQHDFFKSAMPEGYVQERTIFFKDDGNYKTRAEVKFEGDTLVNRIELKGIDFKEDGNILGH
KLEYNYNSHNVYIMADKQKNGIKVNFKIRHNIEDGSVQLADHYQQNTPIGDGPVLLPDNHYLSTQSALSKDPNEKR
DHMVLLEFVTAAGITLGMDELYK*

SEQ ID NO: 182
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDFKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYELHIPIAINKCPKNIFKINTEVRVLLKHDDNPYVIGIDRGERNLLYIVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK

TABLE V.5-continued

LbCas12a-Linker-eGFP Chimeras

NSDGIFYDSRNYEAQENAILPKNADANGAYNIARKVLWAIGQFKKAEDEKLDKVKIAISNKEWLEYAQTSVKH
APAPAPAPA
*MVSKGEELFTGVVPILVELDGDVNGHKFSVSGEGEGDATYGKLTLKFICTTGKLPVPWPTLVTT*
*LTYGVQCFSRYPDHMKQHDFFKSAMPEGYVQERTIFFKDDGNYKTRAEVKFEGDTLVNRIELKGIDFKEDGNILGH*
*KLEYNYNSHNVYIMADKQKNGIKVNFKIRHNIEDGSVQLADHYQQNTPIGDGPVLLPDNHYLSTQSALSKDPNEKR*
*DHMVLLEFVTAAGITLGMDELYK*

SEQ ID NO: 183
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYELHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
APAPAPAPAPA
*MVSKGEELFTGVVPILVELDGDVNGHKFSVSGEGEGDATYGKLTLKFICTTGKLPVPWPTLVTT*
*LTYGVQCFSRYPDHMKQHDFFKSAMPEGYVQERTIFFKDDGNYKTRAEVKFEGDTLVNRIELKGIDFKEDGNILGH*
*KLEYNYNSHNVYIMADKQKNGIKVNFKIRHNIEDGSVQLADHYQQNTPIGDGPVLLPDNHYLSTQSALSKDPNEKR*
*DHMVLLEFVTAAGITLGMDELYK*

SEQ ID NO: 184
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYELHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
APAPAPAPAPA
*MVSKGEELFTGVVPILVELDGDVNGHKFSVSGEGEGDATYGKLTLKFICTTGKLPVPWPTLVTT*
*LTYGVQCFSRYPDHMKQHDFFKSAMPEGYVQERTIFFKDDGNYKTRAEVKFEGDTLVNRIELKGIDFKEDGNILGH*
*KLEYNYNSHNVYIMADKQKNGIKVNFKIRHNIEDGSVQLADHYQQNTPIGDGPVLLPDNHYLSTQSALSKDPNEKR*
*DHMVLLEFVTAAGITLGMDELYK*

SEQ ID NO: 185
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYELHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
APAPAPAPAPAPA
*MVSKGEELFTGVVPILVELDGDVNGHKFSVSGEGEGDATYGKLTLKFICTTGKLPVPWPTLVTT*
*LTYGVQCFSRYPDHMKQHDFFKSAMPEGYVQERTIFFKDDGNYKTRAEVKFEGDTLVNRIELKGIDFKEDGNILGH*
*KLEYNYNSHNVYIMADKQKNGIKVNFKIRHNIEDGSVQLADHYQQNTPIGDGPVLLPDNHYLSTQSALSKDPNEKR*
*DHMVLLEFVTAAGITLGMDELYK*

TABLE V.5-continued

LbCas12a-Linker-eGFP Chimeras

SEQ ID NO: 186
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYELHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
APAPAPAPAPAPAPAPA
*MVSKGEELFTGVVPILVELDGDVNGHKFSVSGEGEGDATYGKLTLKFICTTGKLPVPWPTLVTT*
*LTYGVQCFSRYPDHMKQHDFFKSAMPEGYVQERTIFFKDDGNYKTRAEVKFEGDTLVNRIELKGIDFKEDGNILGH*
*KLEYNYNSHNVYIMADKQKNGIKVNFKIRHNIEDGSVQLADHYQQNTPIGDGPVLLPDNHYLSTQSALSKDPNEKR*
*DHMVLLEFVTAAGITLGMDELYK*

SEQ ID NO: 187
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYELHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
APAPAPAPAPAPAPAPA
*MVSKGEELFTGVVPILVELDGDVNGHKFSVSGEGEGDATYGKLTLKFICTTGKLPVPWPTLVTT*
*LTYGVQCFSRYPDHMKQHDFFKSAMPEGYVQERTIFFKDDGNYKTRAEVKFEGDTLVNRIELKGIDFKEDGNILGH*
*KLEYNYNSHNVYIMADKQKNGIKVNFKIRHNIEDGSVQLADHYQQNTPIGDGPVLLPDNHYLSTQSALSKDPNEKR*
*DHMVLLEFVTAAGITLGMDELYK*

SEQ ID NO: 188
MTQFEGFTNLYQVSKTLRFELIPQGKTLKHIQEQGFIEEDKARNDHYKELKPIIDRIYKTYADQCLQLVQLDWENLS
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYELHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
APAPAPAPAPAPAPAPA
*MVSKGEELFTGVVPILVELDGDVNGHKFSVSGEGEGDATYGKLTLKFICTTGKLPVPWPTLVTT*
*LTYGVQCFSRYPDHMKQHDFFKSAMPEGYVQERTIFFKDDGNYKTRAEVKFEGDTLVNRIELKGIDFKEDGNILGH*
*KLEYNYNSHNVYIMADKQKNGIKVNFKIRHNIEDGSVQLADHYQQNTPIGDGPVLLPDNHYLSTQSALSKDPNEKR*
*DHMVLLEFVTAAGITLGMDELYK*

SEQ ID NO: 189
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIIQKVDEIYKVYGSSEKLFDADFVLEKSLKKNDAVVAIMKDLLDS

TABLE V.5-continued

LbCas12a-Linker-eGFP Chimeras

```
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYELHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
APAPAPAPAPAPAPAPAPAPAPAPA
MVSKGEELFTGVVPILVELDGDVNGHKFSVSGEGEGDATYGKLTLKFICTTGKLPVPWPTLVTT
LTYGVQCFSRYPDHMKQHDFFKSAMPEGYVQERTIFFKDDGNYKTRAEVKFEGDTLVNRIELKGIDFKEDGNILGH
KLEYNYNSHNVYIMADKQKNGIKVNFKIRHNIEDGSVQLADHYQQNTPIGDGPVLLPDNHYLSTQSALSKDPNEKR
DHMVLLEFVTAAGITLGMDELYK

SEQ ID NO: 190
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQKLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYELHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
APAPAPAPAPAPAPAPAPAPAPAPA
MVSKGEELFTGVVPILVELDGDVNGHKFSVSGEGEGDATYGKLTLKFICTTGKLPVPWPTLVTT
LTYGVQCFSRYPDHMKQHDFFKSAMPEGYVQERTIFFKDDGNYKTRAEVKFEGDTLVNRIELKGIDFKEDGNILGH
KLEYNYNSHNVYIMADKQKNGIKVNFKIRHNIEDGSVQLADHYQQNTPIGDGPVLLPDNHYLSTQSALSKDPNEKR
DHMVLLEFVTAAGITLGMDELYK

SEQ ID NO: 191
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQKLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYELHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
APAPAPAPAPAPAPAPAPAPAPAPA
MVSKGEELFTGVVPILVELDGDVNGHKFSVSGEGEGDATYGKLTLKFICTTGKLPVPWPTLVTT
LTYGVQCFSRYPDHMKQHDFFKSAMPEGYVQERTIFFKDDGNYKTRAEVKFEGDTLVNRIELKGIDFKEDGNILGH
KLEYNYNSHNVYIMADKQKNGIKVNFKIRHNIEDGSVQLADHYQQNTPIGDGPVLLPDNHYLSTQSALSKDPNEKR
DHMVLLEFVTAAGITLGMDELYK

SEQ ID NO: 192
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQKLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYELHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
```

TABLE V.5-continued

LbCas12a-Linker-eGFP Chimeras

NSDGIFYDSRNYEAQENAILPKNADANGAYNIARKVLWAIGQFKKAEDEKLDKVKIAISNKEWLEYAQTSVKH
APAPAPAPAPAPAPAPAPAPAPAPA
*MVSKGEELFTGVVPILVELDGDVNGHKFSVSGEGEGDATYGKLTLKFICTTGKLPVPWPTLVTT*
*LTYGVQCFSRYPDHMKQHDFFKSAMPEGYVQERTIFFKDDGNYKTRAEVKFEGDTLVNRIELKGIDFKEDGNILGH*
*KLEYNYNSHNVYIMADKQKNGIKVNFKIRHNIEDGSVQLADHYQQNTPIGDGPVLLPDNHYLSTQSALSKDPNEKR*
*DHMVLLEFVTAAGITLGMDELYK*

SEQ ID NO: 193
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYELHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
XP
*MVSKGEELFTGVVPILVELDGDVNGHKFSVSGEGEGDATYGKLTLKFICTTGKLPVPWPTLVTT*
*LTYGVQCFSRYPDHMKQHDFFKSAMPEGYVQERTIFFKDDGNYKTRAEVKFEGDTLVNRIELKGIDFKEDGNILGH*
*KLEYNYNSHNVYIMADKQKNGIKVNFKIRHNIEDGSVQLADHYQQNTPIGDGPVLLPDNHYLSTQSALSKDPNEKR*
*DHMVLLEFVTAAGITLGMDELYK*

SEQ ID NO: 194
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYELHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
XPXP
*MVSKGEELFTGVVPILVELDGDVNGHKFSVSGEGEGDATYGKLTLKFICTTGKLPVPWPTLVTT*
*LTYGVQCFSRYPDHMKQHDFFKSAMPEGYVQERTIFFKDDGNYKTRAEVKFEGDTLVNRIELKGIDFKEDGNILGH*
*KLEYNYNSHNVYIMADKQKNGIKVNFKIRHNIEDGSVQLADHYQQNTPIGDGPVLLPDNHYLSTQSALSKDPNEKR*
*DHMVLLEFVTAAGITLGMDELYK*

SEQ ID NO: 195
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYELHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
XPXPXP
*MVSKGEELFTGVVPILVELDGDVNGHKFSVSGEGEGDATYGKLTLKFICTTGKLPVPWPTLVTT*
*LTYGVQCFSRYPDHMKQHDFFKSAMPEGYVQERTIFFKDDGNYKTRAEVKFEGDTLVNRIELKGIDFKEDGNILGH*
*KLEYNYNSHNVYIMADKQKNGIKVNFKIRHNIEDGSVQLADHYQQNTPIGDGPVLLPDNHYLSTQSALSKDPNEKR*
*DHMVLLEFVTAAGITLGMDELYK*

TABLE V.5-continued

LbCas12a-Linker-eGFP Chimeras

```
SEQ ID NO: 196
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQKLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYELHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
XPXPXPXP
MVSKGEELFTGVVPILVELDGDVNGHKFSVSGEGEGDATYGKLTLKFICTTGKLPVPWPTLVTT
LTYGVQCFSRYPDHMKQHDFFKSAMPEGYVQERTIFFKDDGNYKTRAEVKFEGDTLVNRIELKGIDFKEDGNILGH
KLEYNYNSHNVYIMADKQKNGIKVNFKIRHNIEDGSVQLADHYQQNTPIGDGPVLLPDNHYLSTQSALSKDPNEKR
DHMVLLEFVTAAGITLGMDELYK

SEQ ID NO: 197
111
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQKLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYELHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
XPXPXPXPXP
MVSKGEELFTGVVPILVELDGDVNGHKFSVSGEGEGDATYGKLTLKFICTTGKLPVPWPTLVTT
LTYGVQCFSRYPDHMKQHDFFKSAMPEGYVQERTIFFKDDGNYKTRAEVKFEGDTLVNRIELKGIDFKEDGNILGH
KLEYNYNSHNVYIMADKQKNGIKVNFKIRHNIEDGSVQLADHYQQNTPIGDGPVLLPDNHYLSTQSALSKDPNEKR
DHMVLLEFVTAAGITLGMDELYK

SEQ ID NO: 198
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQKLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYELHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
XPXPXPXPXP
MVSKGEELFTGVVPILVELDGDVNGHKFSVSGEGEGDATYGKLTLKFICTTGKLPVPWPTLVTT
LTYGVQCFSRYPDHMKQHDFFKSAMPEGYVQERTIFFKDDGNYKTRAEVKFEGDTLVNRIELKGIDFKEDGNILGH
KLEYNYNSHNVYIMADKQKNGIKVNFKIRHNIEDGSVQLADHYQQNTPIGDGPVLLPDNHYLSTQSALSKDPNEKR
DHMVLLEFVTAAGITLGMDELYK

SEQ ID NO: 199
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQKLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIQKVDEIYKVYGSSEKLFDADFVLEKSLKKNDAVVAIMKDLLDS
```

TABLE V.5-continued

LbCas12a-Linker-eGFP Chimeras

```
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYELHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
XPXPXPXPXPXPXP
MVSKGEELFTGVVPILVELDGDVNGHKFSVSGEGEGDATYGKLTLKFICTTGKLPVPWPTLVTT
LTYGVQCFSRYPDHMKQHDFFKSAMPEGYVQERTIFFKDDGNYKTRAEVKFEGDTLVNRIELKGIDFKEDGNILGH
KLEYNYNSHNVYIMADKQKNGIKVNFKIRHNIEDGSVQLADHYQQNTPIGDGPVLLPDNHYLSTQSALSKDPNEKR
DHMVLLEFVTAAGITLGMDELYK

SEQ ID NO: 200
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQKLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYELHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
XPXPXPXPXPXPXP
MVSKGEELFTGVVPILVELDGDVNGHKFSVSGEGEGDATYGKLTLKFICTTGKLPVPWPTLVTT
LTYGVQCFSRYPDHMKQHDFFKSAMPEGYVQERTIFFKDDGNYKTRAEVKFEGDTLVNRIELKGIDFKEDGNILGH
KLEYNYNSHNVYIMADKQKNGIKVNFKIRHNIEDGSVQLADHYQQNTPIGDGPVLLPDNHYLSTQSALSKDPNEKR
DHMVLLEFVTAAGITLGMDELYK

SEQ ID NO: 201
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQKLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYELHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
XPXPXPXPXPXPXP
MVSKGEELFTGVVPILVELDGDVNGHKFSVSGEGEGDATYGKLTLKFICTTGKLPVPWPTLVTT
LTYGVQCFSRYPDHMKQHDFFKSAMPEGYVQERTIFFKDDGNYKTRAEVKFEGDTLVNRIELKGIDFKEDGNILGH
KLEYNYNSHNVYIMADKQKNGIKVNFKIRHNIEDGSVQLADHYQQNTPIGDGPVLLPDNHYLSTQSALSKDPNEKR
DHMVLLEFVTAAGITLGMDELYK

SEQ ID NO: 202
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQKLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYELHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
```

TABLE V.5-continued

LbCas12a-Linker-eGFP Chimeras

NSDGIFYDSRNYEAQENAILPKNADANGAYNIARKVLWAIGQFKKAEDEKLDKVKIAISNKEWLEYAQTSVKH
XPXPXPXPXPXPXPXPXP
*MVSKGEELFTGVVPILVELDGDVNGHKFSVSGEGEGDATYGKLTLKFICTTGKLPVPWPTLVTT*
*LTYGVQCFSRYPDHMKQHDFFKSAMPEGYVQERTIFFKDDGNYKTRAEVKFEGDTLVNRIELKGIDFKEDGNILGH*
*KLEYNYNSHNVYIMADKQKNGIKVNFKIRHNIEDGSVQLADHYQQNTPIGDGPVLLPDNHYLSTQSALSKDPNEKR*
*DHMVLLEFVTAAGITLGMDELYK*

SEQ ID NO: 203
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYELHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
XPXPXPXPXPXPXPXPXPXPXP
*MVSKGEELFTGVVPILVELDGDVNGHKFSVSGEGEGDATYGKLTLKFICTTGKLPVPWPTLVTT*
*LTYGVQCFSRYPDHMKQHDFFKSAMPEGYVQERTIFFKDDGNYKTRAEVKFEGDTLVNRIELKGIDFKEDGNILGH*
*KLEYNYNSHNVYIMADKQKNGIKVNFKIRHNIEDGSVQLADHYQQNTPIGDGPVLLPDNHYLSTQSALSKDPNEKR*
*DHMVLLEFVTAAGITLGMDELYK*

SEQ ID NO: 204
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYELHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
XPXPXPXPXPXPXPXPXP
*MVSKGEELFTGVVPILVELDGDVNGHKFSVSGEGEGDATYGKLTLKFICTTGKLPVPWPTLVTT*
*LTYGVQCFSRYPDHMKQHDFFKSAMPEGYVQERTIFFKDDGNYKTRAEVKFEGDTLVNRIELKGIDFKEDGNILGH*
*KLEYNYNSHNVYIMADKQKNGIKVNFKIRHNIEDGSVQLADHYQQNTPIGDGPVLLPDNHYLSTQSALSKDPNEKR*
*DHMVLLEFVTAAGITLGMDELYK*

SEQ ID NO: 205
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYELHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
XPXPXPXPXPXPXPXPXPXPXP
*MVSKGEELFTGVVPILVELDGDVNGHKFSVSGEGEGDATYGKLTLKFICTTGKLPVPWPTLVTT*
*LTYGVQCFSRYPDHMKQHDFFKSAMPEGYVQERTIFFKDDGNYKTRAEVKFEGDTLVNRIELKGIDFKEDGNILGH*
*KLEYNYNSHNVYIMADKQKNGIKVNFKIRHNIEDGSVQLADHYQQNTPIGDGPVLLPDNHYLSTQSALSKDPNEKR*
*DHMVLLEFVTAAGITLGMDELYK*

TABLE V.5-continued

LbCas12a-Linker-eGFP Chimeras

SEQ ID NO: 206
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIGLNEYINLYNQKTKQLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYELHIPIAINKCPKNIFKINTEVRVLLKHDDNPYVIGIDRGERNLLYIVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
XPXPXPXPXPXPXPXPXPXPXPXP
*MVSKGEELFTGVVPILVELDGDVNGHKFSVSGEGEGDATYGKLTLKFICTTGKLPVPWPTLVTT*
*LTYGVQCFSRYPDHMKQHDFFKSAMPEGYVQERTIFFKDDGNYKTRAEVKFEGDTLVNRIELKGIDFKEDGNILGH*
*KLEYNYNSHNVYIMADKQKNGIKVNFKIRHNIEDGSVQLADHYQQNTPIGDGPVLLPDNHYLSTQSALSKDPNEKR*
*DHMVLLEFVTAAGITLGMDELYK*

SEQ ID NO: 207
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIGLNEYINLYNQKTKQLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYELHIPIAINKCPKNIFKINTEVRVLLKHDDNPYVIGIDRGERNLLYIVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
GGGGSEAAAKGGGGS
*MVSKGEELFTGVVPILVELDGDVNGHKFSVSGEGEGDATYGKLTLKFICTTGKLPVPWPTLVTT*
*LTYGVQCFSRYPDHMKQHDFFKSAMPEGYVQERTIFFKDDGNYKTRAEVKFEGDTLVNRIELKGIDFKEDGNILGH*
*KLEYNYNSHNVYIMADKQKNGIKVNFKIRHNIEDGSVQLADHYQQNTPIGDGPVLLPDNHYLSTQSALSKDPNEKR*
*DHMVLLEFVTAAGITLGMDELYK*

Table V.6 provides chimera fusion proteins between LbCas12a amino acid sequences, linker amino acid sequences (underlined), and mCherry amino acid sequences (bolded, italicized).

TABLE V.6

LbCas12a-Linker-mCherry Chimeras

SEQ ID NO: 208
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIGLNEYINLYNQKTKQLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYELHIPIAINKCPKNIFKINTEVRVLLKHDDNPYVIGIDRGERNLLYIVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP

TABLE V.6-continued

LbCas12a-Linker-mCherry Chimeras

KKNNVEDWEEVCLTSAYKELENKYGINYQQGDIRALLCEQSDKAFYSSFMALMSLMQMRNSITGRTDVDFLISPVK
NSDGIFYDSRNYEAQENAILPKNADANGAYNIARKVLWAIGQFKKAEDEKLDKVKIAISNKEWLEYAQTSVKH
GSAGSAAGSGEF
*MVSKGEEDNMAIIKEFMRFKVHMEGSVNGHEFEIEGEGEGRPYEGTQTAKLKVTKGGPLPF*
*AWDILSPQFMYGSKAYVKHPADIPDYLKLSFPEGFKWERVMNFEDGGVVTVTQDSSLQDGEFIYKVKLRGTNFPSD*
*GPVMQKKTMGWEASSERMYPEDGALKGEIKQRLKLKDGGHYDAEVKTTYKAKKPVQLPGAYNVNIKLDITSHNEDY*
*TIVEQYERAEGRHSTGGMDELYK*

SEQ ID NO: 209
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQKLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYELHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMQMRNSITGRTDVDFLISPVK
NSDGIFYDSRNYEAQENAILPKNADANGAYNIARKVLWAIGQFKKAEDEKLDKVKIAISNKEWLEYAQTSVKH
GGGGSGGGGSGGGGSGGGGS
*MVSKGEEDNMAIIKEFMRFKVHMEGSVNGHEFEIEGEGEGRPYEGTQTAKLKVTKGGPLPF*
*AWDILSPQFMYGSKAYVKHPADIPDYLKLSFPEGFKWERVMNFEDGGVVTVTQDSSLQDGEFIYKVKLRGTNFPSD*
*GPVMQKKTMGWEASSERMYPEDGALKGEIKQRLKLKDGGHYDAEVKTTYKAKKPVQLPGAYNVNIKLDITSHNEDY*
*TIVEQYERAEGRHSTGGMDELYK*

SEQ ID NO: 210
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQKLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYELHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMQMRNSITGRTDVDFLISPVK
NSDGIFYDSRNYEAQENAILPKNADANGAYNIARKVLWAIGQFKKAEDEKLDKVKIAISNKEWLEYAQTSVKH
AEAAAKEAAAKEAAAKEAAAKA
*MVSKGEEDNMAIIKEFMRFKVHMEGSVNGHEFEIEGEGEGRPYEGTQTAKLKVTKGGPLPF*
*AWDILSPQFMYGSKAYVKHPADIPDYLKLSFPEGFKWERVMNFEDGGVVTVTQDSSLQDGEFIYKVKLRGTNFPSD*
*GPVMQKKTMGWEASSERMYPEDGALKGEIKQRLKLKDGGHYDAEVKTTYKAKKPVQLPGAYNVNIKLDITSHNEDY*
*TIVEQYERAEGRHSTGGMDELYK*

SEQ ID NO: 211
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQKLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYELHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMQMRNSITGRTDVDFLISPVK
NSDGIFYDSRNYEAQENAILPKNADANGAYNIARKVLWAIGQFKKAEDEKLDKVKIAISNKEWLEYAQTSVKH
AEAAAKEAAAKEAAAKEAAAKALEAEAAAKEAAAKEAAAKEAAAKA
*MVSKGEEDNMAIIKEFMRFKVHMEGSVNGHEFEIEGEGEGRPYEGTQTAKLKVTKGGPLPF*
*AWDILSPQFMYGSKAYVKHPADIPDYLKLSFPEGFKWERVMNFEDGGVVTVTQDSSLQDGEFIYKVKLRGTNFPSD*
*GPVMQKKTMGWEASSERMYPEDGALKGEIKQRLKLKDGGHYDAEVKTTYKAKKPVQLPGAYNVNIKLDITSHNEDY*
*TIVEQYERAEGRHSTGGMDELYK*

TABLE V.6-continued

LbCas12a-Linker-mCherry Chimeras

SEQ ID NO: 212
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYELHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
LEAEAAAKEAAAKEAAAKEAAAKALEAEAAAKEAAAKEAAAKALE
*MVSKGEEDNMAIIKEFMRFKVHMEGSVNGHEFEIEGEGEGRPYEGTQTAKLKVTKGGPLPF*
*AWDILSPQFMYGSKAYVKHPADIPDYLKLSFPEGFKWERVMNFEDGGVVTVTQDSSLQDGEFIYKVKLRGTNFPSD*
*GPVMQKKTMGWEASSERMYPEDGALKGEIKQRLKLKDGGHYDAEVKTTYKAKKPVQLPGAYNVNIKLDITSHNEDY*
*TIVEQYERAEGRHSTGGMDELYK*

SEQ ID NO: 213
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYELHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
APA
*MVSKGEEDNMAIIKEFMRFKVHMEGSVNGHEFEIEGEGEGRPYEGTQTAKLKVTKGGPLPF*
*AWDILSPQFMYGSKAYVKHPADIPDYLKLSFPEGFKWERVMNFEDGGVVTVTQDSSLQDGEFIYKVKLRGTNFPSD*
*GPVMQKKTMGWEASSERMYPEDGALKGEIKQRLKLKDGGHYDAEVKTTYKAKKPVQLPGAYNVNIKLDITSHNEDY*
*TIVEQYERAEGRHSTGGMDELYK*

SEQ ID NO: 214
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYELHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
APAPA
*MVSKGEEDNMAIIKEFMRFKVHMEGSVNGHEFEIEGEGEGRPYEGTQTAKLKVTKGGPLPF*
*AWDILSPQFMYGSKAYVKHPADIPDYLKLSFPEGFKWERVMNFEDGGVVTVTQDSSLQDGEFIYKVKLRGTNFPSD*
*GPVMQKKTMGWEASSERMYPEDGALKGEIKQRLKLKDGGHYDAEVKTTYKAKKPVQLPGAYNVNIKLDITSHNEDY*
*TIVEQYERAEGRHSTGGMDELYK*

SEQ ID NO: 215
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE

TABLE V.6-continued

LbCas12a-Linker-mCherry Chimeras

TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYELHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
APAPAPA
*MVSKGEEDNMAIIKEFMRFKVHMEGSVNGHEFEIEGEGEGRPYEGTQTAKLKVTKGGPLPF*
*AWDILSPQFMYGSKAYVKHPADIPDYLKLSFPEGFKWERVMNFEDGGVVTVTQDSSLQDGEFIYKVKLRGTNFPSD*
*GPVMQKKTMGWEASSERMYPEDGALKGEIKQRLKLKDGGHYDAEVKTTYKAKKPVQLPGAYNVNIKLDITSHNEDY*
*TIVEQYERAEGRHSTGGMDELYK*

SEQ ID NO: 216
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYELHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
APAPAPAPA
*MVSKGEEDNMAIIKEFMRFKVHMEGSVNGHEFEIEGEGEGRPYEGTQTAKLKVTKGGPLPF*
*AWDILSPQFMYGSKAYVKHPADIPDYLKLSFPEGFKWERVMNFEDGGVVTVTQDSSLQDGEFIYKVKLRGTNFPSD*
*GPVMQKKTMGWEASSERMYPEDGALKGEIKQRLKLKDGGHYDAEVKTTYKAKKPVQLPGAYNVNIKLDITSHNEDY*
*TIVEQYERAEGRHSTGGMDELYK*

SEQ ID NO: 217
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYELHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
APAPAPAPAPA
*MVSKGEEDNMAIIKEFMRFKVHMEGSVNGHEFEIEGEGEGRPYEGTQTAKLKVTKGGPLPF*
*AWDILSPQFMYGSKAYVKHPADIPDYLKLSFPEGFKWERVMNFEDGGVVTVTQDSSLQDGEFIYKVKLRGTNFPSD*
*GPVMQKKTMGWEASSERMYPEDGALKGEIKQRLKLKDGGHYDAEVKTTYKAKKPVQLPGAYNVNIKLDITSHNEDY*
*TIVEQYERAEGRHSTGGMDELYK*

SEQ ID NO: 218
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYELHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT

TABLE V.6-continued

LbCas12a-Linker-mCherry Chimeras

SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
APAPAPAPAPAPAPA
*MVSKGEEDNMAIIKEFMRFKVHMEGSVNGHEFEIEGEGEGRPYEGTQTAKLKVTKGGPLPF*
*AWDILSPQFMYGSKAYVKHPADIPDYLKLSFPEGFKWERVMNFEDGVVTVTQDSSLQDGEFIYKVKLRGTNFPSD*
*GPVMQKKTMGWEASSERMYPEDGALKGEIKQRLKLKDGGHYDAEVKTTYKAKKPVQLPGAYNVNIKLDITSHNEDY*
*TIVEQYERAEGRHSTGGMDELYK*

SEQ ID NO: 219
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQKLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYELHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
APAPAPAPAPAPAPA
*MVSKGEEDNMAIIKEFMRFKVHMEGSVNGHEFEIEGEGEGRPYEGTQTAKLKVTKGGPLPF*
*AWDILSPQFMYGSKAYVKHPADIPDYLKLSFPEGFKWERVMNFEDGVVTVTQDSSLQDGEFIYKVKLRGTNFPSD*
*GPVMQKKTMGWEASSERMYPEDGALKGEIKQRLKLKDGGHYDAEVKTTYKAKKPVQLPGAYNVNIKLDITSHNEDY*
*TIVEQYERAEGRHSTGGMDELYK*

SEQ ID NO: 220
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQKLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYELHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
APAPAPAPAPAPAPA
*MVSKGEEDNMAIIKEFMRFKVHMEGSVNGHEFEIEGEGEGRPYEGTQTAKLKVTKGGPLPF*
*AWDILSPQFMYGSKAYVKHPADIPDYLKLSFPEGFKWERVMNFEDGVVTVTQDSSLQDGEFIYKVKLRGTNFPSD*
*GPVMQKKTMGWEASSERMYPEDGALKGEIKQRLKLKDGGHYDAEVKTTYKAKKPVQLPGAYNVNIKLDITSHNEDY*
*TIVEQYERAEGRHSTGGMDELYK*

SEQ ID NO: 221
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQKLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYELHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
APAPAPAPAPAPAPA
*MVSKGEEDNMAIIKEFMRFKVHMEGSVNGHEFEIEGEGEGRPYEGTQTAKLKVTKGGPLPF*
*AWDILSPQFMYGSKAYVKHPADIPDYLKLSFPEGFKWERVMNFEDGVVTVTQDSSLQDGEFIYKVKLRGTNFPSD*
*GPVMQKKTMGWEASSERMYPEDGALKGEIKQRLKLKDGGHYDAEVKTTYKAKKPVQLPGAYNVNIKLDITSHNEDY*
*TIVEQYERAEGRHSTGGMDELYK*

TABLE V.6-continued

LbCas12a-Linker-mCherry Chimeras

SEQ ID NO: 222
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQKLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYELHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
APAPAPAPAPAPAPAPAPAPA
*MVSKGEEDNMAIIKEFMRFKVHMEGSVNGHEFEIEGEGEGRPYEGTQTAKLKVTKGGPLPF*
*AWDILSPQFMYGSKAYVKHPADIPDYLKLSFPEGFKWERVMNFEDGGVVTVTQDSSLQDGEFIYKVKLRGTNFPSD*
*GPVMQKKTMGWEASSERMYPEDGALKGEIKQRLKLKDGGHYDAEVKTTYKAKKPVQLPGAYNVNIKLDITSHNEDY*
*TIVEQYERAEGRHSTGGMDELYK*

SEQ ID NO: 223
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQKLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYELHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
APAPAPAPAPAPAPAPAPAPA
*MVSKGEEDNMAIIKEFMRFKVHMEGSVNGHEFEIEGEGEGRPYEGTQTAKLKVTKGGPLPF*
*AWDILSPQFMYGSKAYVKHPADIPDYLKLSFPEGFKWERVMNFEDGGVVTVTQDSSLQDGEFIYKVKLRGTNFPSD*
*GPVMQKKTMGWEASSERMYPEDGALKGEIKQRLKLKDGGHYDAEVKTTYKAKKPVQLPGAYNVNIKLDITSHNEDY*
*TIVEQYERAEGRHSTGGMDELYK*

SEQ ID NO: 224
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQKLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDFNFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRFSEDQYELHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYIKKWKLYSYGNRIRIFRNP
KKNNVFDWEEVCLTSAYKELFNKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
APAPAPAPAPAPAPAPAPAPA
*MVSKGEEDNMAIIKEFMRFKVHMEGSVNGHEFEIEGEGEGRPYEGTQTAKLKVTKGGPLPF*
*AWDILSPQFMYGSKAYVKHPADIPDYLKLSFPEGFKWERVMNFEDGGVVTVTQDSSLQDGEFIYKVKLRGTNFPSD*
*GPVMQKKTMGWEASSERMYPEDGALKGEIKQRLKLKDGGHYDAEVKTTYKAKKPVQLPGAYNVNIKLDITSHNEDY*
*TIVEQYERAEGRHSTGGMDELYK*

SEQ ID NO: 225
MSKLEKFTNCYSLSKTLRFKAIPVGKTQENIDNKRLLVEDEKRAEDYKGVKKLLDRYYLSFINDVLHSIKLKNLNNY
ISLERKKIRTEKENKELENLEINLRKEIAKAFKGNEGYKSLFKKDIIETILPEFLDDKDEIALVNSENGETTAFTGF
FDNRENMFSEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQKLPKFKPLYKQVLSDRESLSFYGEGYISDEEVLEVERNIL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY

TABLE V.6-continued

LbCas12a-Linker-mCherry Chimeras

KNGTFKKGDMFNLNDCHKLIDFFKDSISRYPKWSNAYDFNFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRFSEDQYELHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVFDWEEVCLTSAYKELFNKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
<ins>APAPAPAPAPAPAPAPAPAPAPAPAPAPA</ins>
*MVSKGEEDNMAIIKEFMRFKVHMEGSVNGHEFEIEGEGEGRPYEGTQTAKLKVTKGGPLPF*
*AWDILSPQFMYGSKAYVKHPADIPDYLKLSFPEGFKWERVMNFEDGGVVTVTQDSSLQDGEFIYKVKLRGTNFPSD*
*GPVMQKKTMGWEASSERMYPEDGALKGEIKQRLKLKDGGHYDAEVKTTYKAKKPVQLPGAYNVNIKLDITSHNEDY*
*TIVEQYERAEGRHSTGGMDELYK*

SEQ ID NO: 226
MSKLEKFTNCYSLSKTLRFKAIPVGKTQENIDNKRLLVEDEKRAEDYKGVKKLLDRYYLSFINDVLHSIKLKNLNNY
ISLERKKIRTEKENKELENLEINLRKEIAKAFKGNEGYKSLFKKDIIETILPEFLDDKDEIALVNSENGETTAFTGF
FDNRENMFSEEAKSTSIAFRCINENLTRYISNMDIFEKVDAIFDKHEVQEIKEKILNSDYDVEDFFEGEFFNFVLIQ
EGIDVYNAIIGGFVTESGEKIKGLNEYINLYNQKTKQLPKFKPLYKQVLSDRESLSFYGEGYISDEEVLEVERNIL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDFNFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRFSEDQYELHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
<ins>APAPAPAPAPAPAPAPAPAPAPAPAPAPA</ins>
*MVSKGEEDNMAIIKEFMRFKVHMEGSVNGHEFEIEGEGEGRPYEGTQTAKLKVTKGGPLPF*
*AWDILSPQFMYGSKAYVKHPADIPDYLKLSFPEGFKWERVMNFEDGGVVTVTQDSSLQDGEFIYKVKLRGTNFPSD*
*GPVMQKKTMGWEASSERMYPEDGALKGEIKQRLKLKDGGHYDAEVKTTYKAKKPVQLPGAYNVNIKLDITSHNEDY*
*TIVEQYERAEGRHSTGGMDELYK*

SEQ ID NO: 227
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYELHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
<ins>XP</ins>
*MVSKGEEDNMAIIKEFMRFKVHMEGSVNGHEFEIEGEGEGRPYEGTQTAKLKVTKGGPLPF*
*AWDILSPQFMYGSKAYVKHPADIPDYLKLSFPEGFKWERVMNFEDGGVVTVTQDSSLQDGEFIYKVKLRGTNFPSD*
*GPVMQKKTMGWEASSERMYPEDGALKGEIKQRLKLKDGGHYDAEVKTTYKAKKPVQLPGAYNVNIKLDITSHNEDY*
*TIVEQYERAEGRHSTGGMDELYK*

SEQ ID NO: 228
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYELHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
<ins>XPXP</ins>

TABLE V.6-continued

LbCas12a-Linker-mCherry Chimeras

*MVSKGEEDNMAIIKEFMRFKVHMEGSVNGHEFEIEGEGEGRPYEGTQTAKLKVTKGGPLPF*
*AWDILSPQFMYGSKAYVKHPADIPDYLKLSFPEGFKWERVMNFEDGVVTVTQDSSLQDGEFIYKVKLRGTNFPSD*
*GPVMQKKTMGWEASSERMYPEDGALKGEIKQRLKLKDGGHYDAEVKTTYKAKKPVQLPGAYNVNIKLDITSHNEDY*
*TIVEQYERAEGRHSTGGMDELYK*

SEQ ID NO: 229
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQKLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYELHIPIAINKCPKNIFKINTEVRVLLKHDDNPYVIGIDRGERNLLYIVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
XPXPXP
*MVSKGEEDNMAIIKEFMRFKVHMEGSVNGHEFEIEGEGEGRPYEGTQTAKLKVTKGGPLPF*
*AWDILSPQFMYGSKAYVKHPADIPDYLKLSFPEGFKWERVMNFEDGVVTVTQDSSLQDGEFIYKVKLRGTNFPSD*
*GPVMQKKTMGWEASSERMYPEDGALKGEIKQRLKLKDGGHYDAEVKTTYKAKKPVQLPGAYNVNIKLDITSHNEDY*
*TIVEQYERAEGRHSTGGMDELYK*

SEQ ID NO: 230
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQKLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYELHIPIAINKCPKNIFKINTEVRVLLKHDDNPYVIGIDRGERNLLYIVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
XPXPXPXP
*MVSKGEEDNMAIIKEFMRFKVHMEGSVNGHEFEIEGEGEGRPYEGTQTAKLKVTKGGPLPF*
*AWDILSPQFMYGSKAYVKHPADIPDYLKLSFPEGFKWERVMNFEDGVVTVTQDSSLQDGEFIYKVKLRGTNFPSD*
*GPVMQKKTMGWEASSERMYPEDGALKGEIKQRLKLKDGGHYDAEVKTTYKAKKPVQLPGAYNVNIKLDITSHNEDY*
*TIVEQYERAEGRHSTGGMDELYK*

SEQ ID NO: 231
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQKLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYELHIPIAINKCPKNIFKINTEVRVLLKHDDNPYVIGIDRGERNLLYIVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
XPXPXPXP
*MVSKGEEDNMAIIKEFMRFKVHMEGSVNGHEFEIEGEGEGRPYEGTQTAKLKVTKGGPLPF*
*AWDILSPQFMYGSKAYVKHPADIPDYLKLSFPEGFKWERVMNFEDGVVTVTQDSSLQDGEFIYKVKLRGTNFPSD*
*GPVMQKKTMGWEASSERMYPEDGALKGEIKQRLKLKDGGHYDAEVKTTYKAKKPVQLPGAYNVNIKLDITSHNEDY*
*TIVEQYERAEGRHSTGGMDELYK*

SEQ ID NO: 232
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ

TABLE V.6-continued

LbCas12a-Linker-mCherry Chimeras

```
EGIDVYNAIIGGFVTESGEKIKGLNEYINLYNQKTKQKLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIIQKVDEIYKVYGSSEKLFDADFVLEKSLKKNDAVVAIMKDLLDS
VKSFENYIKAFFGEGKETNRDESFYGDFVLAYDILLLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYELHIPIAINKCPKNIFKINTEVRVLLKHDDNPYVIGIDRGERNLLYIVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
XPXPXPXPXPXP
```
*MVSKGEEDNMAI IKEFMRFKVHMEGSVNGHEFEIEGEGEGRPYEGTQTAKLKVTKGGPLPF*
*AWDILSPQFMYGSKAYVKHPADIPDYLKLSFPEGFKWERVMNFEDGGVVTVTQDSSLQDGEFIYKVKLRGTNFPSD*
*GPVMQKKTMGWEASSERMYPEDGALKGEIKQRLKLKDGGHYDAEVKTTYKAKKPVQLPGAYNVNIKLDITSHNEDY*
*TIVEQYERAEGRHSTGGMDELYK*

SEQ ID NO: 233
```
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQKLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIIQKVDEIYKVYGSSEKLFDADFVLEKSLKKNDAVVAIMKDLLDS
VKSFENYIKAFFGEGKETNRDESFYGDFVLAYDILLLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYELHIPIAINKCPKNIFKINTEVRVLLKHDDNPYVIGIDRGERNLLYIVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
XPXPXPXPXPXP
```
*MVSKGEEDNMAI IKEFMRFKVHMEGSVNGHEFEIEGEGEGRPYEGTQTAKLKVTKGGPLPF*
*AWDILSPQFMYGSKAYVKHPADIPDYLKLSFPEGFKWERVMNFEDGGVVTVTQDSSLQDGEFIYKVKLRGTNFPSD*
*GPVMQKKTMGWEASSERMYPEDGALKGEIKQRLKLKDGGHYDAEVKTTYKAKKPVQLPGAYNVNIKLDITSHNEDY*
*TIVEQYERAEGRHSTGGMDELYK*

SEQ ID NO: 234
```
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQKLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIIQKVDEIYKVYGSSEKLFDADFVLEKSLKKNDAVVAIMKDLLDS
VKSFENYIKAFFGEGKETNRDESFYGDFVLAYDILLLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYELHIPIAINKCPKNIFKINTEVRVLLKHDDNPYVIGIDRGERNLLYIVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
XPXPXPXPXPXP
```
*MVSKGEEDNMAI IKEFMRFKVHMEGSVNGHEFEIEGEGEGRPYEGTQTAKLKVTKGGPLPF*
*AWDILSPQFMYGSKAYVKHPADIPDYLKLSFPEGFKWERVMNFEDGGVVTVTQDSSLQDGEFIYKVKLRGTNFPSD*
*GPVMQKKTMGWEASSERMYPEDGALKGEIKQRLKLKDGGHYDAEVKTTYKAKKPVQLPGAYNVNIKLDITSHNEDY*
*TIVEQYERAEGRHSTGGMDELYK*

SEQ ID NO: 235
```
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQKLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIIQKVDEIYKVYGSSEKLFDADFVLEKSLKKNDAVVAIMKDLLDS
VKSFENYIKAFFGEGKETNRDESFYGDFVLAYDILLLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYELHIPIAINKCPKNIFKINTEVRVLLKHDDNPYVIGIDRGERNLLYIVVDGK
GNIVEQYSLNEIINNFNGIRIKTDYHSLLDKKEKERFEARQNWTSIENIKELKAGYISQVVHKICELVEKYDAVIAL
```

TABLE V.6-continued

LbCas12a-Linker-mCherry Chimeras

EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
XPXPXPXPXPXPXPXPXP
*MVSKGEEDNMAIIKEFMRFKVHMEGSVNGHEFEIEGEGEGRPYEGTQTAKLKVTKGGPLPF*
*AWDILSPQFMYGSKAYVKHPADIPDYLKLSFPEGFKWERVMNFEDGGVVTVTQDSSLQDGEFIYKVKLRGTNFPSD*
*GPVMQKKTMGWEASSERMYPEDGALKGEIKQRLKLKDGGHYDAEVKTTYKAKKPVQLPGAYNVNIKLDITSHNEDY*
*TIVEQYERAEGRHSTGGMDELYK*

SEQ ID NO: 236
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIGLNEYINLYNQKTKQLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVHPANSPIANKNP
DNPKKITTLSYDVYKDKRESEDQYELHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
XPXPXPXPXPXPXPXPXP
*MVSKGEEDNMAIIKEFMRFKVHMEGSVNGHEFEIEGEGEGRPYEGTQTAKLKVTKGGPLPF*
*AWDILSPQFMYGSKAYVKHPADIPDYLKLSFPEGFKWERVMNFEDGGVVTVTQDSSLQDGEFIYKVKLRGTNFPSD*
*GPVMQKKTMGWEASSERMYPEDGALKGEIKQRLKLKDGGHYDAEVKTTYKAKKPVQLPGAYNVNIKLDITSHNEDY*
*TIVEQYERAEGRHSTGGMDELYK*

SEQ ID NO: 237
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIGLNEYINLYNQKTKQLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVHPANSPIANKNP
DNPKKITTLSYDVYKDKRESEDQYELHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
XPXPXPXPXPXPXPXPXP
*MVSKGEEDNMAIIKEFMRFKVHMEGSVNGHEFEIEGEGEGRPYEGTQTAKLKVTKGGPLPF*
*AWDILSPQFMYGSKAYVKHPADIPDYLKLSFPEGFKWERVMNFEDGGVVTVTQDSSLQDGEFIYKVKLRGTNFPSD*
*GPVMQKKTMGWEASSERMYPEDGALKGEIKQRLKLKDGGHYDAEVKTTYKAKKPVQLPGAYNVNIKLDITSHNEDY*
*TIVEQYERAEGRHSTGGMDELYK*

SEQ ID NO: 238
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIGLNEYINLYNQKTKQLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDFNSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVHPANSPIANKNP
DNPKKITTLSYDVYKDKRFSEDQYELHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVFDWEEVCLTSAYKELFNKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
XPXPXPXPXPXPXPXPXPXP
*MVSKGEEDNMAIIKEFMRFKVHMEGSVNGHEFEIEGEGEGRPYEGTQTAKLKVTKGGPLPF*
*AWDILSPQFMYGSKAYVKHPADIPDYLKLSFPEGFKWERVMNFEDGGVVTVTQDSSLQDGEFIYKVKLRGTNFPSD*
*GPVMQKKTMGWEASSERMYPEDGALKGEIKQRLKLKDGGHYDAEVKTTYKAKKPVQLPGAYNVNIKLDITSHNEDY*
*TIVEQYERAEGRHSTGGMDELYK*

TABLE V.6-continued

LbCas12a-Linker-mCherry Chimeras

SEQ ID NO: 239
MSKLEKFTNCYSLSKTLRFKAIPVGKTQENIDNKRLLVEDEKRAEDYKGVKKLLDRYYLSFINDVLHSIKLKNLNNY
ISLERKKIRTEKENKELENLEINLRKEIAKAFKGNEGYKSLFKKDIIETILPEFLDDKDEIALVNSENGETTAFTGF
FDNRENMFSEEAKSTSIAFRCINENLTRYISNMDIFEKVDAIFDKHEVQEIKEKILNSDYDVEDFFEGEFFNFVLIQ
EGIDVYNAIIGGFVTESGEKIKGLNEYINLYNQKTKQKLPKFKPLYKQVLSDRESLSFYGEGYISDEEVLEVERNIL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDFNFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRFSEDQYELHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVFDWEEVCLTSAYKELFNKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
<u>XPXPXPXPXPXPXPXPXPXPXPXP</u>
*MVSKGEEDNMAIIKEFMRFKVHMEGSVNGHEFEIEGEGEGRPYEGTQTAKLKVTKGGPLPF*
*AWDILSPQFMYGSKAYVKHPADIPDYLKLSFPEGFKWERVMNFEDGGVVTVTQDSSLQDGEFIYKVKLRGTNFPSD*
*GPVMQKKTMGWEASSERMYPEDGALKGEIKQRLKLKDGGHYDAEVKTTYKAKKPVQLPGAYNVNIKLDITSHNEDY*
*TIVEQYERAEGRHSTGGMDELYK*

SEQ ID NO: 240
MSKLEKFTNCYSLSKTLRFKAIPVGKTQENIDNKRLLVEDEKRAEDYKGVKKLLDRYYLSFINDVLHSIKLKNLNNY
ISLERKKIRTEKENKELENLEINLRKEIAKAFKGNEGYKSLFKKDIIETILPEFLDDKDEIALVNSENGETTAFTGF
FDNRENMFSEEAKSTSIAFRCINENLTRYISNMDIFEKVDAIFDKHEVQEIKEKILNSDYDVEDFFEGEFFNFVLIQ
EGIDVYNAIIGGFVTESGEKIKGLNEYINLYNQKTKQKLPKFKPLYKQVLSDRESLSFYGEGYISDEEVLEVERNIL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDFNFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRFSEDQYELHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
<u>XPXPXPXPXPXPXPXPXPXPXPXP</u>
*MVSKGEEDNMAIIKEFMRFKVHMEGSVNGHEFEIEGEGEGRPYEGTQTAKLKVTKGGPLPF*
*AWDILSPQFMYGSKAYVKHPADIPDYLKLSFPEGFKWERVMNFEDGGVVTVTQDSSLQDGEFIYKVKLRGTNFPSD*
*GPVMQKKTMGWEASSERMYPEDGALKGEIKQRLKLKDGGHYDAEVKTTYKAKKPVQLPGAYNVNIKLDITSHNEDY*
*TIVEQYERAEGRHSTGGMDELYK*

FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQKLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYELHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
<u>GGGGSEAAAKGGGGS</u>
*MVSKGEEDNMAIIKEFMRFKVHMEGSVNGHEFEIEGEGEGRPYEGTQTAKLKVTKGGPLPF*
*AWDILSPQFMYGSKAYVKHPADIPDYLKLSFPEGFKWERVMNFEDGGVVTVTQDSSLQDGEFIYKVKLRGTNFPSD*
*GPVMQKKTMGWEASSERMYPEDGALKGEIKQRLKLKDGGHYDAEVKTTYKAKKPVQLPGAYNVNIKLDITSHNEDY*
*TIVEQYERAEGRHSTGGMDELYK*

Table V.7 provides chimera fusion proteins between LbCas12a variant amino acid sequences (E795L), linker amino acid sequences (underlined), and eGFP amino acid sequences (bolded, italicized).

TABLE V.7

LbCas12a(E795L)-Linker-eGFP Chimeras

SEQ ID NO: 242
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQKLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYLLHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
GSAGSAAGSGEF
***MVSKGEELFTGVVPILVELDGDVNGHKFSVSGEGEGDATYGKLTLKFICTTGKLPVPWPTLVTT
LTYGVQCFSRYPDHMKQHDFFKSAMPEGYVQERTIFFKDDGNYKTRAEVKFEGDTLVNRIELKGIDFKEDGNILGH
KLEYNYNSHNVYIMADKQKNGIKVNFKIRHNIEDGSVQLADHYQQNTPIGDGPVLIPDNHYLSTQSALSKDPNEKR
DHMVLLEFVTAAGITLGMDELYK***

SEQ ID NO: 243
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQKLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYLLHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
GGGGSGGGGSGGGGSGGGGS
***MVSKGEELFTGVVPILVELDGDVNGHKFSVSGEGEGDATYGKLTLKFICTTGKLPVPWPTLVTT
LTYGVQCFSRYPDHMKQHDFFKSAMPEGYVQERTIFFKDDGNYKTRAEVKFEGDTLVNRIELKGIDFKEDGNILGH
KLEYNYNSHNVYIMADKQKNGIKVNFKIRHNIEDGSVQLADHYQQNTPIGDGPVLIPDNHYLSTQSALSKDPNEKR
DHMVLLEFVTAAGITLGMDELYK***

SEQ ID NO: 244
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQKLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYLLHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
AEAAAKEAAAKEAAAKEAAAKA
***MVSKGEELFTGVVPILVELDGDVNGHKFSVSGEGEGDATYGKLTLKFICTTGKLPVPWPTLVTT
LTYGVQCFSRYPDHMKQHDFFKSAMPEGYVQERTIFFKDDGNYKTRAEVKFEGDTLVNRIELKGIDFKEDGNILGH
KLEYNYNSHNVYIMADKQKNGIKVNFKIRHNIEDGSVQLADHYQQNTPIGDGPVLIPDNHYLSTQSALSKDPNEKR
DHMVLLEFVTAAGITLGMDELYK***

SEQ ID NO: 245
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQKLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR

TABLE V.7-continued

LbCas12a(E795L)-Linker-eGFP Chimeras

RKSFKKIGSFSLEQLQEYADADLSVVEKLKEIIIQKVDEIYKVYGSSEKLFDADFVLEKSLKKNDAVVAIMKDLLDS
VKSFENYIKAFFGEGKETNRDESFYGDFVLAYDILLKVDHIYDAIRNYTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYLLHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
AEAAAKEAAAKEAAAKEAAAKALEAEAAAKEAAAKEAAAKEAAAKA
*MVSKGEELFTGVVPILVELDGDVNGHKFSVSGEGEGDATYGKLTLKFICTTGKLPVPWPTLVTT*
*LTYGVQCFSRYPDHMKQHDFFKSAMPEGYVQERTIFFKDDGNYKTRAEVKFEGDTLVNRIELKGIDFKEDGNILGH*
*KLEYNYNSHNVYIMADKQKNGIKVNFKIRHNIEDGSVQLADHYQQNTPIGDGPVLIPDNHYLSTQSALSKDPNEKR*
*DHMVLLEFVTAAGITLGMDELYK*

SEQ ID NO: 246
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQKLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIIQKVDEIYKVYGSSEKLFDADFVLEKSLKKNDAVVAIMKDLLDS
VKSFENYIKAFFGEGKETNRDESFYGDFVLAYDILLKVDHIYDAIRNYTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYLLHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
LEAEAAAKEAAAKEAAAKEAAAKALEAEAAAKEAAAKEAAAKEAAAKALE
*MVSKGEELFTGVVPILVELDGDVNGHKFSVSGEGEGDATYGKLTLKFICTTGKLPVPWPTLVTT*
*LTYGVQCFSRYPDHMKQHDFFKSAMPEGYVQERTIFFKDDGNYKTRAEVKFEGDTLVNRIELKGIDFKEDGNILGH*
*KLEYNYNSHNVYIMADKQKNGIKVNFKIRHNIEDGSVQLADHYQQNTPIGDGPVLIPDNHYLSTQSALSKDPNEKR*
*DHMVLLEFVTAAGITLGMDELYK*

SEQ ID NO: 247
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQKLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIIQKVDEIYKVYGSSEKLFDADFVLEKSLKKNDAVVAIMKDLLDS
VKSFENYIKAFFGEGKETNRDESFYGDFVLAYDILLKVDHIYDAIRNYTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYLLHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
APA
*MVSKGEELFTGVVPILVELDGDVNGHKFSVSGEGEGDATYGKLTLKFICTTGKLPVPWPTLVTT*
*LTYGVQCFSRYPDHMKQHDFFKSAMPEGYVQERTIFFKDDGNYKTRAEVKFEGDTLVNRIELKGIDFKEDGNILGH*
*KLEYNYNSHNVYIMADKQKNGIKVNFKIRHNIEDGSVQLADHYQQNTPIGDGPVLIPDNHYLSTQSALSKDPNEKR*
*DHMVLLEFVTAAGITLGMDELYK*

SEQ ID NO: 248
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQKLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIIQKVDEIYKVYGSSEKLFDADFVLEKSLKKNDAVVAIMKDLLDS
VKSFENYIKAFFGEGKETNRDESFYGDFVLAYDILLKVDHIYDAIRNYTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYLLHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSGNRIRIFRNP

TABLE V.7-continued

LbCas12a(E795L)-Linker-eGFP Chimeras

KKNNVEDWEEVCLTSAYKELENKYGINYQQGDIRALLCEQSDKAFYSSFMALMSLMQMRNSITGRTDVDFLISPVK
NSDGIFYDSRNYEAQENAILPKNADANGAYNIARKVLWAIGQFKKAEDEKLDKVKIAISNKEWLEYAQTSVKH
APAPA
*MVSKGEELFTGVVPILVELDGDVNGHKFSVSGEGEGDATYGKLTLKFICTTGKLPVPWPTLVTT*
*LTYGVQCFSRYPDHMKQHDFFKSAMPEGYVQERTIFFKDDGNYKTRAEVKFEGDTLVNRIELKGIDFKEDGNILGH*
*KLEYNYNSHNVYIMADKQKNGIKVNFKIRHNIEDGSVQLADHYQQNTPIGDGPVLIPDNHYLSTQSALSKDPNEKR*
*DHMVLLEFVTAAGITLGMDELYK*

SEQ ID NO: 249
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQKLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYLLHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMQMRNSITGRTDVDFLISPVK
NSDGIFYDSRNYEAQENAILPKNADANGAYNIARKVLWAIGQFKKAEDEKLDKVKIAISNKEWLEYAQTSVKH
APAPAPA
*MVSKGEELFTGVVPILVELDGDVNGHKFSVSGEGEGDATYGKLTLKFICTTGKLPVPWPTLVTT*
*LTYGVQCFSRYPDHMKQHDFFKSAMPEGYVQERTIFFKDDGNYKTRAEVKFEGDTLVNRIELKGIDFKEDGNILGH*
*KLEYNYNSHNVYIMADKQKNGIKVNFKIRHNIEDGSVQLADHYQQNTPIGDGPVLIPDNHYLSTQSALSKDPNEKR*
*DHMVLLEFVTAAGITLGMDELYK*

SEQ ID NO: 250
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQKLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYLLHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMQMRNSITGRTDVDFLISPVK
NSDGIFYDSRNYEAQENAILPKNADANGAYNIARKVLWAIGQFKKAEDEKLDKVKIAISNKEWLEYAQTSVKH
APAPAPAPA
*MVSKGEELFTGVVPILVELDGDVNGHKFSVSGEGEGDATYGKLTLKFICTTGKLPVPWPTLVTT*
*LTYGVQCFSRYPDHMKQHDFFKSAMPEGYVQERTIFFKDDGNYKTRAEVKFEGDTLVNRIELKGIDFKEDGNILGH*
*KLEYNYNSHNVYIMADKQKNGIKVNFKIRHNIEDGSVQLADHYQQNTPIGDGPVLIPDNHYLSTQSALSKDPNEKR*
*DHMVLLEFVTAAGITLGMDELYK*

SEQ ID NO: 251
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQKLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYLLHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMQMRNSITGRTDVDFLISPVK
NSDGIFYDSRNYEAQENAILPKNADANGAYNIARKVLWAIGQFKKAEDEKLDKVKIAISNKEWLEYAQTSVKH
APAPAPAPAPA
*MVSKGEELFTGVVPILVELDGDVNGHKFSVSGEGEGDATYGKLTLKFICTTGKLPVPWPTLVTT*
*LTYGVQCFSRYPDHMKQHDFFKSAMPEGYVQERTIFFKDDGNYKTRAEVKFEGDTLVNRIELKGIDFKEDGNILGH*
*KLEYNYNSHNVYIMADKQKNGIKVNFKIRHNIEDGSVQLADHYQQNTPIGDGPVLIPDNHYLSTQSALSKDPNEKR*
*DHMVLLEFVTAAGITLGMDELYK*

TABLE V.7-continued

LbCas12a(E795L)-Linker-eGFP Chimeras

SEQ ID NO: 252
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQKLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYLLHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
APAPAPAPAPAPA
*MVSKGEELFTGVVPILVELDGDVNGHKFSVSGEGEGDATYGKLTLKFICTTGKLPVPWPTLVTT*
*LTYGVQCFSRYPDHMKQHDFFKSAMPEGYVQERTIFFKDDGNYKTRAEVKFEGDTLVNRIELKGIDFKEDGNILGH*
*KLEYNYNSHNVYIMADKQKNGIKVNFKIRHNIEDGSVQLADHYQQNTPIGDGPVLIPDNHYLSTQSALSKDPNEKR*
*DHMVLLEFVTAAGITLGMDELYK*

SEQ ID NO: 253
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQKLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYLLHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
APAPAPAPAPAPAPA
*MVSKGEELFTGVVPILVELDGDVNGHKFSVSGEGEGDATYGKLTLKFICTTGKLPVPWPTLVTT*
*LTYGVQCFSRYPDHMKQHDFFKSAMPEGYVQERTIFFKDDGNYKTRAEVKFEGDTLVNRIELKGIDFKEDGNILGH*
*KLEYNYNSHNVYIMADKQKNGIKVNFKIRHNIEDGSVQLADHYQQNTPIGDGPVLIPDNHYLSTQSALSKDPNEKR*
*DHMVLLEFVTAAGITLGMDELYK*

SEQ ID NO: 254
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQKLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYLLHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
APAPAPAPAPAPA
*MVSKGEELFTGVVPILVELDGDVNGHKFSVSGEGEGDATYGKLTLKFICTTGKLPVPWPTLVTT*
*LTYGVQCFSRYPDHMKQHDFFKSAMPEGYVQERTIFFKDDGNYKTRAEVKFEGDTLVNRIELKGIDFKEDGNILGH*
*KLEYNYNSHNVYIMADKQKNGIKVNFKIRHNIEDGSVQLADHYQQNTPIGDGPVLIPDNHYLSTQSALSKDPNEKR*
*DHMVLLEFVTAAGITLGMDELYK*

SEQ ID NO: 255
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQKLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE

TABLE V.7-continued

LbCas12a(E795L)-Linker-eGFP Chimeras

TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYLLHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
APAPAPAPAPAPAPAPAPA
*MVSKGEELFTGVVPILVELDGDVNGHKFSVSGEGEGDATYGKLTLKFICTTGKLPVPWPTLVTT*
*LTYGVQCFSRYPDHMKQHDFFKSAMPEGYVQERTIFFKDDGNYKTRAEVKFEGDTLVNRIELKGIDFKEDGNILGH*
*KLEYNYNSHNVYIMADKQKNGIKVNFKIRHNIEDGSVQLADHYQQNTPIGDGPVLIPDNHYLSTQSALSKDPNEKR*
*DHMVLLEFVTAAGITLGMDELYK*

SEQ ID NO: 256
MTQFEGFTNLYQVSKTLRFELIPQGKTLKHIQEQGFIEEDKARNDHYKELKPIIDRIYKTYADQCLQLVQLDWENLS
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQKLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYLLHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
APAPAPAPAPAPAPAPAPA
*MVSKGEELFTGVVPILVELDGDVNGHKFSVSGEGEGDATYGKLTLKFICTTGKLPVPWPTLVTT*
*LTYGVQCFSRYPDHMKQHDFFKSAMPEGYVQERTIFFKDDGNYKTRAEVKFEGDTLVNRIELKGIDFKEDGNILGH*
*KLEYNYNSHNVYIMADKQKNGIKVNFKIRHNIEDGSVQLADHYQQNTPIGDGPVLIPDNHYLSTQSALSKDPNEKR*
*DHMVLLEFVTAAGITLGMDELYK*

SEQ ID NO: 257
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQKLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYLLHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
APAPAPAPAPAPAPAPAPA
*MVSKGEELFTGVVPILVELDGDVNGHKFSVSGEGEGDATYGKLTLKFICTTGKLPVPWPTLVTT*
*LTYGVQCFSRYPDHMKQHDFFKSAMPEGYVQERTIFFKDDGNYKTRAEVKFEGDTLVNRIELKGIDFKEDGNILGH*
*KLEYNYNSHNVYIMADKQKNGIKVNFKIRHNIEDGSVQLADHYQQNTPIGDGPVLIPDNHYLSTQSALSKDPNEKR*
*DHMVLLEFVTAAGITLGMDELYK*

SEQ ID NO: 258
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQKLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYLLHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK

TABLE V.7-continued

LbCas12a(E795L)-Linker-eGFP Chimeras

NSDGIFYDSRNYEAQENAILPKNADANGAYNIARKVLWAIGQFKKAEDEKLDKVKIAISNKEWLEYAQTSVKH
APAPAPAPAPAPAPAPAPAPAPAPA
*MVSKGEELFTGVVPILVELDGDVNGHKFSVSGEGEGDATYGKLTLKFICTTGKLPVPWPTLVTT*
*LTYGVQCFSRYPDHMKQHDFFKSAMPEGYVQERTIFFKDDGNYKTRAEVKFEGDTLVNRIELKGIDFKEDGNILGH*
*KLEYNYNSHNVYIMADKQKNGIKVNFKIRHNIEDGSVQLADHYQQNTPIGDGPVLIPDNHYLSTQSALSKDPNEKR*
*DHMVLLEFVTAAGITLGMDELYK*

SEQ ID NO: 259
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQKLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYLLHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
APAPAPAPAPAPAPAPAPAPAPAPA
*MVSKGEELFTGVVPILVELDGDVNGHKFSVSGEGEGDATYGKLTLKFICTTGKLPVPWPTLVTT*
*LTYGVQCFSRYPDHMKQHDFFKSAMPEGYVQERTIFFKDDGNYKTRAEVKFEGDTLVNRIELKGIDFKEDGNILGH*
*KLEYNYNSHNVYIMADKQKNGIKVNFKIRHNIEDGSVQLADHYQQNTPIGDGPVLIPDNHYLSTQSALSKDPNEKR*
*DHMVLLEFVTAAGITLGMDELYK*

SEQ ID NO: 260
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQKLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYLLHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
APAPAPAPAPAPAPAPAPAPAPA
*MVSKGEELFTGVVPILVELDGDVNGHKFSVSGEGEGDATYGKLTLKFICTTGKLPVPWPTLVTT*
*LTYGVQCFSRYPDHMKQHDFFKSAMPEGYVQERTIFFKDDGNYKTRAEVKFEGDTLVNRIELKGIDFKEDGNILGH*
*KLEYNYNSHNVYIMADKQKNGIKVNFKIRHNIEDGSVQLADHYQQNTPIGDGPVLIPDNHYLSTQSALSKDPNEKR*
*DHMVLLEFVTAAGITLGMDELYK*

SEQ ID NO: 261
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQKLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYLLHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
XP
*MVSKGEELFTGVVPILVELDGDVNGHKFSVSGEGEGDATYGKLTLKFICTTGKLPVPWPTLVTT*
*LTYGVQCFSRYPDHMKQHDFFKSAMPEGYVQERTIFFKDDGNYKTRAEVKFEGDTLVNRIELKGIDFKEDGNILGH*
*KLEYNYNSHNVYIMADKQKNGIKVNFKIRHNIEDGSVQLADHYQQNTPIGDGPVLIPDNHYLSTQSALSKDPNEKR*
*DHMVLLEFVTAAGITLGMDELYK*

TABLE V.7-continued

LbCas12a(E795L)-Linker-eGFP Chimeras

SEQ ID NO: 262
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQKLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYLLHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
XPXP
*MVSKGEELFTGVVPILVELDGDVNGHKFSVSGEGEGDATYGKLTLKFICTTGKLPVPWPTLVTT*
*LTYGVQCFSRYPDHMKQHDFFKSAMPEGYVQERTIFFKDDGNYKTRAEVKFEGDTLVNRIELKGIDFKEDGNILGH*
*KLEYNYNSHNVYIMADKQKNGIKVNFKIRHNIEDGSVQLADHYQQNTPIGDGPVLIPDNHYLSTQSALSKDPNEKR*
*DHMVLLEFVTAAGITLGMDELYK*

SEQ ID NO: 263
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQKLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYLLHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
XPXPX
*MVSKGEELFTGVVPILVELDGDVNGHKFSVSGEGEGDATYGKLTLKFICTTGKLPVPWPTLVTT*
*LTYGVQCFSRYPDHMKQHDFFKSAMPEGYVQERTIFFKDDGNYKTRAEVKFEGDTLVNRIELKGIDFKEDGNILGH*
*KLEYNYNSHNVYIMADKQKNGIKVNFKIRHNIEDGSVQLADHYQQNTPIGDGPVLIPDNHYLSTQSALSKDPNEKR*
*DHMVLLEFVTAAGITLGMDELYK*

SEQ ID NO: 264
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQKLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYLLHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
XPXPXP
*MVSKGEELFTGVVPILVELDGDVNGHKFSVSGEGEGDATYGKLTLKFICTTGKLPVPWPTLVTT*
*LTYGVQCFSRYPDHMKQHDFFKSAMPEGYVQERTIFFKDDGNYKTRAEVKFEGDTLVNRIELKGIDFKEDGNILGH*
*KLEYNYNSHNVYIMADKQKNGIKVNFKIRHNIEDGSVQLADHYQQNTPIGDGPVLIPDNHYLSTQSALSKDPNEKR*
*DHMVLLEFVTAAGITLGMDELYK*

SEQ ID NO: 265
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQKLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE

TABLE V.7-continued

LbCas12a(E795L)-Linker-eGFP Chimeras

TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYLLHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
XPXPXPXPXP
*MVSKGEELFTGVVPILVELDGDVNGHKFSVSGEGEGDATYGKLTLKFICTTGKLPVPWPTLVTT*
*LTYGVQCFSRYPDHMKQHDFFKSAMPEGYVQERTIFFKDDGNYKTRAEVKFEGDTLVNRIELKGIDFKEDGNILGH*
*KLEYNYNSHNVYIMADKQKNGIKVNFKIRHNIEDGSVQLADHYQQNTPIGDGPVLIPDNHYLSTQSALSKDPNEKR*
*DHMVLLEFVTAAGITLGMDELYK*

SEQ ID NO: 266
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIGLNEYINLYNQKTKQLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYLLHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
XPXPXPXPXP
*MVSKGEELFTGVVPILVELDGDVNGHKFSVSGEGEGDATYGKLTLKFICTTGKLPVPWPTLVTT*
*LTYGVQCFSRYPDHMKQHDFFKSAMPEGYVQERTIFFKDDGNYKTRAEVKFEGDTLVNRIELKGIDFKEDGNILGH*
*KLEYNYNSHNVYIMADKQKNGIKVNFKIRHNIEDGSVQLADHYQQNTPIGDGPVLIPDNHYLSTQSALSKDPNEKR*
*DHMVLLEFVTAAGITLGMDELYK*

SEQ ID NO: 267
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIGLNEYINLYNQKTKQLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYLLHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
XPXPXPXPXPXP
*MVSKGEELFTGVVPILVELDGDVNGHKFSVSGEGEGDATYGKLTLKFICTTGKLPVPWPTLVTT*
*LTYGVQCFSRYPDHMKQHDFFKSAMPEGYVQERTIFFKDDGNYKTRAEVKFEGDTLVNRIELKGIDFKEDGNILGH*
*KLEYNYNSHNVYIMADKQKNGIKVNFKIRHNIEDGSVQLADHYQQNTPIGDGPVLIPDNHYLSTQSALSKDPNEKR*
*DHMVLLEFVTAAGITLGMDELYK*

SEQ ID NO: 268
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIGLNEYINLYNQKTKQLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYLLHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT

TABLE V.7-continued

LbCas12a(E795L)-Linker-eGFP Chimeras

SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
XPXPXPXPXPXPXPXP
*MVSKGEELFTGVVPILVELDGDVNGHKFSVSGEGEGDATYGKLTLKFICTTGKLPVPWPTLVTT*
*LTYGVQCFSRYPDHMKQHDFFKSAMPEGYVQERTIFFKDDGNYKTRAEVKFEGDTLVNRIELKGIDFKEDGNILGH*
*KLEYNYNSHNVYIMADKQKNGIKVNFKIRHNIEDGSVQLADHYQQNTPIGDGPVLIPDNHYLSTQSALSKDPNEKR*
*DHMVLLEFVTAAGITLGMDELYK*

SEQ ID NO: 269
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQKLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYLLHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
XPXPXPXPXPXPXPXP
*MVSKGEELFTGVVPILVELDGDVNGHKFSVSGEGEGDATYGKLTLKFICTTGKLPVPWPTLVTT*
*LTYGVQCFSRYPDHMKQHDFFKSAMPEGYVQERTIFFKDDGNYKTRAEVKFEGDTLVNRIELKGIDFKEDGNILGH*
*KLEYNYNSHNVYIMADKQKNGIKVNFKIRHNIEDGSVQLADHYQQNTPIGDGPVLIPDNHYLSTQSALSKDPNEKR*
*DHMVLLEFVTAAGITLGMDELYK*

SEQ ID NO: 270
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQKLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYLLHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
XPXPXPXPXPXPXPXPXP
*MVSKGEELFTGVVPILVELDGDVNGHKFSVSGEGEGDATYGKLTLKFICTTGKLPVPWPTLVTT*
*LTYGVQCFSRYPDHMKQHDFFKSAMPEGYVQERTIFFKDDGNYKTRAEVKFEGDTLVNRIELKGIDFKEDGNILGH*
*KLEYNYNSHNVYIMADKQKNGIKVNFKIRHNIEDGSVQLADHYQQNTPIGDGPVLIPDNHYLSTQSALSKDPNEKR*
*DHMVLLEFVTAAGITLGMDELYK*

SEQ ID NO: 271
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQKLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYLLHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
XPXPXPXPXPXPXPXPXP
*MVSKGEELFTGVVPILVELDGDVNGHKFSVSGEGEGDATYGKLTLKFICTTGKLPVPWPTLVTT*
*LTYGVQCFSRYPDHMKQHDFFKSAMPEGYVQERTIFFKDDGNYKTRAEVKFEGDTLVNRIELKGIDFKEDGNILGH*
*KLEYNYNSHNVYIMADKQKNGIKVNFKIRHNIEDGSVQLADHYQQNTPIGDGPVLIPDNHYLSTQSALSKDPNEKR*
*DHMVLLEFVTAAGITLGMDELYK*

TABLE V.7-continued

LbCas12a(E795L)-Linker-eGFP Chimeras

SEQ ID NO: 272
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQKLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYLLHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
XPXPXPXPXPXPXPXPXPXPXP
*MVSKGEELFTGVVPILVELDGDVNGHKFSVSGEGEGDATYGKLTLKFICTTGKLPVPWPTLVTT*
*LTYGVQCFSRYPDHMKQHDFFKSAMPEGYVQERTIFFKDDGNYKTRAEVKFEGDTLVNRIELKGIDFKEDGNILGH*
*KLEYNYNSHNVYIMADKQKNGIKVNFKIRHNIEDGSVQLADHYQQNTPIGDGPVLIPDNHYLSTQSALSKDPNEKR*
*DHMVLLEFVTAAGITLGMDELYK*

SEQ ID NO: 273
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQKLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYLLHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
XPXPXPXPXPXPXPXPXPXPXP
*MVSKGEELFTGVVPILVELDGDVNGHKFSVSGEGEGDATYGKLTLKFICTTGKLPVPWPTLVTT*
*LTYGVQCFSRYPDHMKQHDFFKSAMPEGYVQERTIFFKDDGNYKTRAEVKFEGDTLVNRIELKGIDFKEDGNILGH*
*KLEYNYNSHNVYIMADKQKNGIKVNFKIRHNIEDGSVQLADHYQQNTPIGDGPVLIPDNHYLSTQSALSKDPNEKR*
*DHMVLLEFVTAAGITLGMDELYK*

SEQ ID NO: 274
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQKLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYLLHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
XPXPXPXPXPXPXPXPXPXPXP
*MVSKGEELFTGVVPILVELDGDVNGHKFSVSGEGEGDATYGKLTLKFICTTGKLPVPWPTLVTT*
*LTYGVQCFSRYPDHMKQHDFFKSAMPEGYVQERTIFFKDDGNYKTRAEVKFEGDTLVNRIELKGIDFKEDGNILGH*
*KLEYNYNSHNVYIMADKQKNGIKVNFKIRHNIEDGSVQLADHYQQNTPIGDGPVLIPDNHYLSTQSALSKDPNEKR*
*DHMVLLEFVTAAGITLGMDELYK*

SEQ ID NO: 275
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQKLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY

TABLE V.7-continued

LbCas12a(E795L)-Linker-eGFP Chimeras

```
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYLLHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
GGGGSEAAAKGGGGS
MVSKGEELFTGVVPILVELDGDVNGHKFSVSGEGEGDATYGKLTLKFICTTGKLPVPWPTLVTT
LTYGVQCFSRYPDHMKQHDFFKSAMPEGYVQERTIFFKDDGNYKTRAEVKFEGDTLVNRIELKGIDFKEDGNILGH
KLEYNYNSHNVYIMADKQKNGIKVNFKIRHNIEDGSVQLADHYQQNTPIGDGPVLIPDNHYLSTQSALSKDPNEKR
DHMVLLEFVTAAGITLGMDELYK
```

Table V.8 provides chimera fusion proteins between LbCas12a variant amino acid sequences (E795L), linker amino acid sequences (underlined), and mCherry amino acid sequences (bolded, italicized).

TABLE V.8

LbCas12a(E795L)-Linker-mCherry Chimeras

```
SEQ ID NO: 276
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSFNGFTTAFTGF
FDNRENMFSEEAKSTSIAFRCINENLTRYISNMDIFEKVDAIFDKHEVQEIKEKILNSDYDVEDFFEGEFFNFVLTQ
EGIDVYNAIIGGFVTESGEKIKGLNEYINLYNQKTKQKLPKFKPLYKQVLSDRESLSFYGEGYTSDEEVLEVFRNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGNKMLPKVFFSKKWMAYYNPSEDIQKIY
KNGTFKKGDMFNLNDCHKLIDFFKDSISRYPKWSNAYDFNFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKTTTLSYDVYKDKRFSEDQYLLHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVFDWEEVCLTSAYKELFNKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
GSAGSAAGSGEFMVSKGEEDNMAIIKEFMRFKVHMEGSVNGHEFEIEGEGEGRPYEGTQTAKLKVTKGGPLPFAWD
ILSPQFMYGSKAYVKHPADIPDYLKLSFPEGFKWERVMNFEDGGVVTVTQDSSLQDGEFIYKVKLRGTNFPSDGPV
MQKKTMGWEASSERMYPEDGALKGEIKQRLKLKDGGHYDAEVKTTYKAKKPVQLPGAYNVNIKLDITSHNEDYTIV
EQYERAEGRHSTGGMDELYK

SEQ ID NO: 277
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSFNGFTTAFTGF
FDNRENMFSEEAKSTSIAFRCINENLTRYISNMDIFEKVDAIFDKHEVQEIKEKILNSDYDVEDFFEGEFFNFVLTQ
EGIDVYNAIIGGFVTESGEKIKGLNEYINLYNQKTKQKLPKFKPLYKQVLSDRESLSFYGEGYTSDEEVLEVFRNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRFSEDQYLLHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVFDWEEVCLTSAYKELFNKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
GGGGSGGGGSGGGGSGGGGSMVSKGEEDNMAIIKEFMRFKVHMEGSVNGHEFEIEGEGEGRPYEGTQTAKLKVTKG
GPLPFAWDILSPQFMYGSKAYVKHPADIPDYLKLSFPEGFKWERVMNFEDGGVVTVTQDSSLQDGEFIYKVKLRGT
NFPSDGPVMQKKTMGWEASSERMYPEDGAIKGEIKQRLKLKDGGHYDAEVKTTYKAKKPVQLPGAYNVNIKLDITS
HNEDYTIVEQYERAEGRHSTGGMDELYK

SEQ ID NO: 278
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSFNGFTTAFTGF
FDNRENMESEEAKSTSIAFRCINENLTRYISNMDIFEKVDAIFDKHEVQEIKEKILNSDYDVEDFFEGEFFNFVLTQ
EGIDVYNAIIGGFVTESGEKIKGLNEYINLYNQKTKQKLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
```

TABLE V.8-continued

LbCas12a(E795L)-Linker-mCherry Chimeras

VEEGKLYMFQIYNKDFSDKSHGTPNLHTMYFKLLFDENNHGQIRLSGGAELFMRRASLKKEELVVHPANSPIANKNP
DNPKKITTLSYDVYKDKRFSEDQYLLHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVFDWEEVCLTSAYKELFNKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
AEAAAKEAAAKEAAAKEAAAK*MVSKGEEDNMAIIKEFMRFKVHMEGSVNGHEFEIEGEGEGRPYEGTQTAKLKVT*
*KGGPLPFAWDILSPQFMYGSKAYVKHPADIPDYLKLSFPEGFKWERVMNFEDGGVVTVTQDSSLQDGEFIYKVKLR*
*GTNFPSDGPVMQKKTMGWEASSERMYPEDGALKGEIKQRLKLKDGGHYDAEVKTTYKAKKPVQLPGAYNVNIKLDI*
*TSHNEDYTIVEQYERAEGRHSTGGMDELYK*

SEQ ID NO: 279
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSFNGFTTAFTGF
FDNRENMFSEEAKSTSIAFRCINENLTRYISNMDIFEKVDAIFDKHEVQEIKEKILNSDYDVEDFFEGEFFNFVLTQ
EGIDVYNAIIGGFVTESGEKIKGLNEYINLYNQKTKQKLPKFKPLYKQVLSDRESLSFYGEGYTSDEEVLEVFRNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKTTTLSYDVYKDKRFSEDQYLLHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVFDWEEVCLTSAYKELFNKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
AEAAAKEAAAKEAAAKEAAAKALEAEAAAKEAAAKEAAAKEAAAK*MVSKGEEDNMAIIKEFMRFKVHMEGSVNGH*
*EFEIEGEGEGRPYEGTQTAKLKVTKGGPLPFAWDILSPQFMYGSKAYVKHPADIPDYLKLSFPEGFKWERVMNFED*
*GGVVTVTQDSSLQDGEFIYKVKLRGTNFPSDGPVMQKKTMGWEASSERMYPEDGALKGEIKQRLKLKDGGHYDAEV*
*KTTYKAKKPVQLPGAYNVNIKLDITSHNEDYTIVEQYERAEGRHSTGGMDELYK*

SEQ ID NO: 280
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSFNGFTTAFTGF
FDNRENMFSEEAKSTSIAFRCINENLTRYISNMDIFEKVDAIFDKHEVQEIKEKILNSDYDVEDFFEGEFFNEVLTQ
EGIDVYNAIIGGFVTESGEKIKGLNEYINLYNQKTKQKLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDFNFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKTTTLSYDVYKDKRFSEDQYLLHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVFDWEEVCLTSAYKELFNKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
LEAEAAAKEAAAKEAAAKEAAAKALEAEAAAKEAAAKEAAAKEAAAKALE*MVSKGEEDNMAIIKEFMRFKVHMEGSV*
*NGHEFEIEGEGEGRPYEGTQTAKLKVTKGGPLPFAWDILSPQFMYGSKAYVKHPADIPDYLKLSFPEGFKWERVMNF*
*EDGGVVTVTQDSSLQDGEFIYKVKLRGTNFPSDGPVMQKKTMGWEASSERMYPEDGALKGEIKQRLKLKDGGHYDAE*
*VKTTYKAKKPVQLPGAYNVNIKLDITSHNEDYTIVEQYERAEGRHSTGGMDELYK*

SEQ ID NO: 281
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSFNGFTTAFTGF
FDNRENMFSEEAKSTSIAFRCINENLTRYISNMDIFEKVDAIFDKHEVQEIKEKILNSDYDVEDFFEGEFFNFVLTQ
EGIDVYNAIIGGFVTESGEKIKGLNEYINLYNQKTKQKLPKFKPLYKQVLSDRESLSFYGEGYTSDEEVLEVFRNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDFNFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKTTTLSYDVYKDKRFSEDQYLLHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVFDWEEVCLTSAYKELFNKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
APA*MVSKGEEDNMAIIKEFMRFKVHMEGSVNGHEFEIEGEGEGRPYEGTQTAKLKVTKGGPLPFAWDILSPQFMYG*
*SKAYVKHPADIPDYLKLSFPEGFKWERVMNFEDGGVVTVTQDSSLQDGEFIYKVKLRGTNFPSDGPVMQKKTMGWE*

TABLE V.8-continued

LbCas12a(E795L)-Linker-mCherry Chimeras

ASSERMYPEDGALKGEIKQRLKLKDGGHYDEVKTTYKAKKPVQLPGAYNVNIKLLITSHNEDYTIVEQYERAEGR
HSTGGMDELYK

SEQ ID NO: 282
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGF
FDNRENMFSEEAKSTSIAFRCINENLTRYISNMDIFEKVDAIFDKHEVQEIKEKILNSDYDVEDFFEGEFFNEVLTQ
EGIDVYNAIIGGFVTESGEKIKGLNEYINLYNQKTKQKLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKTTTLSYDVYKDKRFSEDQYLLHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVFDWEEVCLTSAYKELFNKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
APAPAMVSKGEEDNMAIIKEFMRFKVHMEGSVNGHEFEIEGEGEGRPYEGTQTAKLKVTKGGPLPFAWDILSPQFM
YGSKAYVKHPADIPDYLKLSFPEGFKWERVMNFEIGGVVTVTQDSSLQDGEFIYKVKLIGTNFPSDGPVMQKKTMG
WEASSERMYPEDGALKGEIKQRLKLKDGGHYDAEVKTTYKAKKPVQLPGAYNVNIKLDITSHNEDYTIVEQYERAE
GRHSTGGMDELYK

SEQ ID NO: 283
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSFNGFTTAFTGF
FDNRENMFSEEAKSTSIAFRCINENLTRYISNMDIFEKVDAIFDKHEVQEIKEKILNSDYDVEDFFEGEFFNFVLTQ
EGIDVYNAIIGGFVTESGEKIKGLNEYINLYNQKTKQKLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDFNSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKTTTLSYDVYKDKRESEDQYLLHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVFDWEEVCLTSAYKELFNKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
APAPAPAMVSKGEEDNMAIIKEFMRFKVHMEGSVNGHEFEIEGEGEGRPYEGTQTAKLKVTKGGPLPFAWDILSPQ
FMYGSKAYVKHPADIPDYLKLSFPEGFKWERVMNFEDGGVVTVTQDSSLQDGEFIYKVKLRGTNFPSDGPVMQKKT
MGWEASSERMYPEDGALKGEIKQRLKLKDGHYDAEVKTTYKAKKPVQLPGANVNIKLDITSHNEDYTIVEQYER
AEGRHSTGGMDELYK

SEQ ID NO: 284
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGF
FDNRENMFSEEAKSTSIAFRCINENLTRYISNMDIFEKVDAIFDKHEVQEIKEKILNSDYDVEDFFEGEFFNEVLTQ
EGIDVYNAIIGGFVTESGEKIKGLNEYINLYNQKTKQKLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDFNSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKTTTLSYDVYKDKRFSEDQYLLHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVFDWEEVCLTSAYKELFNKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
APAPAPAPAMVSKGEEDNMAIIKEFMRFKVHMEGSVNGHEFEIEGEGEGRPYEGDTAKLKVTKGGPLPFAWDILS
PQFMYGSKAYVKHPADIPDYLKLSFPEGFKWERVMNFEDGGVVTVTQDSSLQDGEFIYKVKLRGTNFPSDGPVMQK
KTMGWEASSERMYPEDGALKGEIKQRLKLKDGGHYDAEVKTTYKAKKPVQLPGAYNVNIKLDITSHNEDYTIVEQY
ERAEGRHSTGGMDELYK

SEQ ID NO: 285
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGFTTAFTGF
FDNRENMFSEEAKSTSIAFRCINENLTRYISNMDIFEKVDAIFDKHEVQEIKEKILNSDYDVEDFFEGEFFNFVLTQ
EGIDVYNAIIGGFVTESGEKIKGLNEYINLYNQKTKQKLPKFKPLYKQVLSDRESLSFYGEGYTSDEEVLEVFRNTL

TABLE V.8-continued

LbCas12a(E795L)-Linker-mCherry Chimeras

NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKTTTLSYDVYKDKRFSEDQYLLHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVFDWEEVCLTSAYKELFNKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
APAPAPAPAPAPA*MVSKGEEDNMAIIKEFMRFKVHMEGSVNGHEFEIEGEGEGRPYEGTQTAKLKVTKGGPLPFAWDI
LSPQFMYGSKAYVKHPADIPDYLKLSFPEGFK*WERVMNFEDGGVVTVTQDSSLQDGEFIYKVKLRGTNFPSDGPVM
QKKTMGWEASSERMYPEDGALKGEIKQRLKL*DGGHYDAEVKTTYKAKKPVQLPGAYNVNIKLDITSHNEDYTIVE
QYERAEGRHSTGGMDELYK*

SEQ ID NO: 286
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMFSEEAKSTSIAFRCINENLTRYISNMDIFEKVDAIFDKHEVQEIKEKILNSDYDVEDFFEGEFFNEVLTQ
EGIDVYNAIIGGFVTESGEKIKGLNEYINLYNQKTKQKLPKFKPLYKQVLSDRESLSFYGEGYTSDEEVLEVFRNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRFSEDQYLLHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
APAPAPAPAPAPA*MVSKGEEDNMAIIKEFMRFKVHMEGSVNGHEFEIEG:GEGRPYEGTAKLKVTKGGPLPFAW
DILSPQFMYGSKAYVKHPADIPDYLKLSFP*EGFKWERVMNFEDGGVVTVTQDSSLQDGEFIYKVKLRGTNFPSDGP
VMQKKTMGWEASSERMYPEDGALKGEIKQH*LKLKDGGHYDAEVKTTYKAKKPVQ*LPGAYNVNIKLDITSHNEDYTI
VEQYERAEGRHSTGGMDELYK*

SEQ ID NO: 287
MSKLEKFTNCYSLSKTLRFKAIPVGKTQENIDNKRLLVEDEKRAEDYKGVKKLLDRYYLSFINDVLHSIKLKNLNNY
ISLFRKKTREKENKELENLEINLRKEIAKAFKGNEGYKSLFKKDIIETILPEFLDDKDEIALVNSENGETTAFTGF
FDNRENMESEEAKSTSIAFRCINENLTRYISNMDIFEKVDAIFDKHEVQEIKEKILNSDYDVEDFFEGEFFNEVLTQ
EGIDVYNAIIGGFVTESGEKIKGLNEYINLYNQKTKQKLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKTTTLSYDVYKDKRFSEDQYLLHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVFDWEEVCLTSAYKELFNKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
APAPAPAPAPAPAPA*MVSKGEEDNMAIIKEFMRFKVHMEGSVNGH*FEIEGEGEGRPYEGTQTAKLKVTKGGPLPF
AWDILSPQFMYGSKAYVKHPADIPDYLKLSFPEG*KWERVMNFEDGGVVTVTQDS*LQDGEFIYKVKLRGTNFPSD
GPVMQKKTMGWEASSERMYPEDGALKGEIKQRLK*LKDGGHYDAEVKTTYKAKKPVQLPGAYNVNIKLDITSHNEDY
TIVEQYERAEGRHSTGGMDELYK*

SEQ ID NO: 288
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSFNGFTTAFTGF
FDNRENMFSEEAKSTSIAFRCINENLTRYISNMDIFEKVDAIFDKHEVQEIKEKILNSDYDVEDFFEGEFFNEVLTQ
EGIDVYNAIIGGFVTESGEKIKGLNEYINLYNQKTKQKLPKFKPLYKQVLSDRESLSFYGEGYTSDEEVLEVFRNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKTTTLSYDVYKDKRESEDQYLLHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL

TABLE V.8-continued

LbCas12a(E795L)-Linker-mCherry Chimeras

EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSGNRIRIFRNP
KKNNVFDWEEVCLTSAYKELENKYGINYQQGDIRALLCEQSDKAFYSSFMALMSLMLQMRNSITGRTDVDFLSPVK
NSDGIFYDSRNYEAQENAILPKNADAGAYNIARKVLWAIGQFKKAEDEKLDKVKIAISNKEWLEYAQTSVKH
APAPAPAPAPAPAPAPA*MVSKGEEDNMAIIKEFMRFKVHMEGSVNGHEFEIEGEGEGRPYEGTQTAKLKVTKGGPL
PFAWDILSPQFMYGSKAYVKHPADIPDYLKLSFPEGFKWERVMNFEDGGVVTVTQDSSLQDGEFIYKVKLRGTNFP
SDGPVMQKKTMGWEASSERMYPEDGALKGEIKQRLKLKDGGHYDAEVKTTYKAKKPVQLPGAYNVNIKLDITSHNE
DYTIVEQYERAEGRHSTGGMDELYK*

SEQ ID NO: 289
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGF
FDNRENMESEEAKSTSIAFRCINENLTRYISNMDIFEKVDAIFDKHEVQEIKEKILNSDYDVEDFFEGEFFNFVLTQ
EGIDVYNAIIGGFVTESGEKIKGLNEYINLYNQKTKQKLPKFKPLYKQVLSDRESLSFYGEGYTSDEEVLEVFRNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNMKLPKVFFSSKKWMAYYNPSEDIQKIY
KNGTFKKGDMFNLNDCHKLIDFFKDSISRYPKWSNAYDFNFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRFSEDQYLLHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSGNRIRIFRNP
KKNNVFDWEEVCLTSAYKELFNKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
APAPAPAPAPAPAPAPA*MVSKGEEDNMAIIKEFMRFKVHMEGSVNGHEFEIEGEGEGRPYEGTQTAKLKVTKGG
PLPFAWDILSPQFMYGSKAYVKHPADIPDYLKLSFPEGFKWERVMNFEDGGVVTVTQDSSLQDGEFIYKVKLRGTN
FPSDGPVMQKKTMGWEASSERMYPEDGALKGEIKQRLKLKDGGHYDAEVKTTYKAKKIVQLPGAYNVNIKLDITSH
NEDYTIVEQYERAEGRHSTGGMDELYK*

SEQ ID NO: 290
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSFNGFTTAFTGF
FDNRENMFSEEAKSTSIAFRCINENLTRYISNMDIFEKVDAIFDKHEVQEIKEKILNSDYDVEDFFEGEFFNEVLTQ
EGIDVYNAIIGGFVTESGEKIKGLNEYINLYNQKTKQKLPKFKPLYKQVLSDRESLSFYGEGYTSDEEVLEVFRNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDFNFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRFSEDQYLLHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSGNRIRIFRNP
KKNNVFDWEEVCLTSAYKELFNKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
APAPAPAPAPAPAPAPA*MVSKGEEDNMAIIKEFMRFKVHMEGSVNGHEFEIEGEGEGRPYEGTQTAKLKVTK
GGPLPFAWDILSPQFMYGSKAYVKHPADIPDYLKLSFPEGFKWERVMNFEDGGVVTVTQDSSLQDGEFIYKVKLRG
TNFPSDGPVMQKKTMGWEASSERMYPEDGALKGEIKQRLKLKDGGHYDAEVKTTYKAKKPVQLPGAYNVNIKLDIT
SHNEDYTIVEQYERAEGRHSTGGMDELYK*

SEQ ID NO: 291
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSFNGFTTAFTGF
FDNRENMFSEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQKLPKFKPLYKQVLSDRESLSFYGEGYTSDEEVLEVFRNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPNKMLPKYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRFSEDQYLLHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSGNRIRIFRNP
KKNNVFDWEEVCLTSAYKELFNKYGINYQQGDIRALLCEQSDKAFYSSFMALMSLMLQMRNSITGRTDVDFLISPVK

TABLE V.8-continued

LbCas12a(E795L)-Linker-mCherry Chimeras

NSDGIFYDSRNYEAQENAILPKNADANGAYNIARKVLWAIGQFKKAEDEKLDKVKIAISNKEWLEYAQTSVKH
APAPAPAPAPAPAPAPAPAPAPAPA*MVSKGEEDNMAIIKEFMRFKVHMEGSVNGHEFEIEGEGEGRPYEGTQTAKLKV*
*TKGGPLPFAWDILSPQFMYGSKAYVKHPADIPDYIKLSFPEGFKWERVMNFEDGGVVTVTQDSSLQDGEFIYKVKL*
*RGTNFPSDGPVMQKKTMGWEASSERMYPEDGALKGEIKQRLKLKDGGHYDAEVKTTYKAKKPVQLPGAYNVNIKLD*
*ITSHNEDYTIVEQYERAEGRHSTGGMDELYK*

SEQ ID NO: 292
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMFSEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQLPKFKPLYQVLSDRESLSFYGEGYTSDEEVLEVFRNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDFNFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKTTTLSYDVYKDKRFSEDQYLLHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVFDWEEVCLTSAYKELFNKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
APAPAPAPAPAPAPAPAPAPAPAPA*MVSKGEEDNMAIIKEFMRFKVHMEGSVNGHEFEIEGEGEGRPYEGTQTAKL*
*KVTKGGPLPFAWDILSPQFMYGSKAYVKHPADIPDYLKLSFPEGFKWERVMNFEDGGVVTVTQDSSLQDGEFIYKV*
*KLRGTNFPSDGPVMQKKTMGWEASSERMYPEDGALKGEIKQRLKLKDGGHYDAEVKTTYKAKKPVQLPGAYNVNIK*
*LDITSHNEDYTIVEQYERAEGRHSTGGMDELYK*

SEQ ID NO: 293
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSFNGETTAFTGE
FDNRENMFSEEAKSTSIAFRCINENLTRYISNMDIFEKVDAIFDKHEVQEIKEKILNSDYDVEDFFEGEFFNFVLTQ
EGIDVYNAIIGGFVTESGEKIKGLNEYINLYNQKTKQLPKFKPLYQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDFNFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKTTTLSYDVYKDKRFSEDQYLLHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVFDWEEVCLTSAYKELFNKYGINYQQGDIRALLCEQSDKAFYSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
APAPAPAPAPAPAPAPAPAPAPAPA*MVSKGEEDNMAIIKEFMRFKVHMEGSVNGHEFEIEGEGEGRPYEGTQTA*
*KLKVTKGGPLPFAWDILSPQFMYGSKAYVKHPADIPDYLKLSFPEGFKWERVMNFEIGGVVTVTQDSSLQDGEFIY*
*KVKLRGTNFPSDGPVMQKKTMGWEASSERMYPEIGALKGEIKQRLKLKDGGHYDAEVKTTYKAKKPVQLPGAYNVN*
*IKLDITSHNEDYTIVEQYERAEGRHSTGGMDELYK*

SEQ ID NO: 294
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNFVLTQ
EGIDVYNAIIGGFVTESGEKIKGLNEYINLYNQKTKQLPKFKPLYQVLSDRESLSFYGEGYTSDEEVLEVFRNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKTTTLSYDVYKDKRFSEDQYLLHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVFDWEEVCLTSAYKELFNKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
APAPAPAPAPAPAPAPAPAPAPAPA*MVSKGEEDNMAIIKEFMRFKVHMEGSVNGHEFEIEGEGEGRPYEGTQ*
*TAKLKVTKGGPLPFAWDILSPQFMYGSKAWKHPADIPDYLKLSFPEGFKWERVMNFEDGGVVTVTQDSSLQDGEF*
*IYKVKLRGTNFPSDGPVMQKKTMGWEASSRMYPEDGALKGEIKQRLKLKDGGHYIDAEVKTTYKAKKPVQLPGAYN*
*VNIKLDITSHNEDYTIVEQYERAEGRHSTGGMDELYK*

TABLE V.8-continued

LbCas12a(E795L)-Linker-mCherry Chimeras

SEQ ID NO: 295
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSFNGFTTAFTGF
FDNRENMFSEEAKSTSIAFRCINENLTRYISNMDIFEKVDAIFDKHEVQEIKEKILNSDYDVEDFFEGEFFNEVLIQ
EGIDVYNAIIGGFVTESGEKIKGLNEYINLYNQKTKQKLPKFKPLYQVLSDRESLSFYGEGYTSDEEVLEVFRNTL
NKNSEIFSSIKKLEKLFKNFDEYSSAGIFVKNGPAISTISKDIFGEWNIRDKWNAEYDDIHLKKKAVVTEKYEDDR
RKSFKKIGSFSLEQLQEYADADLSVVEKLKEIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDFNFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRFSEDQYLLHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYIKKWKLYSYGNRIRIFRNP
KKNNVFDWEEVCLTSAYKELFNKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
XP*MVSKGEEDNMAIIKEFMRFKVHMEGSVNGHEFEIEGEGEGRPYEGTQTAKLKVTKGGPLPFAWDILSPQFMYGS
KAYVKHPADIPDYLKLSFPEGFKWERVMNFEDGGVVTVTQDSSLQDGEFIYKVKRGTNFPSDGPVMQKKTMGWEA
SSERMYPEDGALKGEIKQRLKLKDGGHYDAEVKTTYKAKKPVQLPGAYNVNIKLDITSHNEDYTIVEQYERAEGRH
STGGMDELYK*

SEQ ID NO: 296
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGF
FDNRENMESEEAKSTSIAFRCINENLTRYISNMDIFEKVDAIFDKHEVQEIKEKILNSDYDVEDFFEGEFFNFVLTQ
EGIDVYNAIIGGFVTESGEKIKGLNEYINLYNQKTKQKLPKFKPLYQVLSDRESLSFYGEGYTSDEEVLEVERNTL
NKNSEIFSSIKKLEKLFKNFDEYSSAGIFVKNGPAISTISKDIFGEWNIRDKWNAEYDDIHLKKKAVVTEKYEDDR
RKSFKKIGSFSLEQLQEYADADLSVVEKLKEIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRFSEDQYLLHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVFDWEEVCLTSAYKELFNKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
XPXP*MVSKGEEDNMAIIKEFMRFKVHMEGSVNGHEFEIEGEGEGRPYEGTQTAKLKVTKGGPLPFAWDILSPQFMY/
GSKAYVKHPADIPDYLKLSFPEGFKWERVMNFEDGGVVTVTQDSSLQDGEFIYKVKLRGTNFPSDGPVMQKKTMGW
EASSERMYPEDGALKGEIKQRLKLKDGGHYDAEVKTTYKAKKPVQLPGAYNVNIKLDITSHNEDYTIVEQYERAEG
RHSTGGMDELYK*

SEQ ID NO: 297
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSFNGFTTAFTGF
FDNRENMFSEEAKSTSIAFRCINENLTRYISNMDIFEKVDAIFDKHEVQEIKEKILNSDYDVEDFFEGEFFNEVLTQ
EGIDVYNAIIGGFVTESGEKIKGLNEYINLYNQKTKQKLPKFKPLYQVLSDRESLSFYGEGYTSDEEVLEVERNTL
NKNSEIFSSIKKLEKLFKNFDEYSSAGIFVKNGPAISTISKDIFGEWNIRDKWNAEYDDIHLKKKAVVTEKYEDDR
RKSFKKIGSFSLEQLQEYADADLSVVEKLKEIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDFNFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRFSEDQYLLHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYIKKWKLYSYGNRIRIFRNP
KKNNVFDWEEVCLTSAYKELFNKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
XPXPXP*MVSKGEEDNMAIIKEFMRFKVHMEGSVNGHEFEIEGEGEGRPYEGTQTAKLKVTKGGPLPFAWDILSPQF
MYGSKAYVKHPADIPDYLKLSFPEGFKWERVMNFEDGGVVTVTQDSSLQDGEFIYKVKLRGTNFPSDGPVMQKKTM
GWEASSERMYPEDGALKGEIKQRLKLKDGGHYDAEVKTTYKAKKPVQLPGAYNVNIKLDITSHNEDYTIVEQYERA
EGRHSTGGMDELYK*

SEQ ID NO: 298
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGF
FDNRENMFSEEAKSTSIAFRCINENLTRYISNMDIFEKVDAIFDKHEVQEIKEKILNSDYDVEDFFEGEFFNFVLTQ
EGIDVYNAIIGGFVTESGEKIKGLNEYINLYNQKTKQKLPKFKPLYQVLSDRESLSFYGEGYTSDEEVLEVFRNTL
NKNSEIFSSIKKLEKLFKNFDEYSSAGIFVKNGPAISTISKDIFGEWNIRDKWNAEYDDIHLKKKAVVTEKYEDDR
RKSFKKIGSFSLEQLQEYADADLSVVEKLKEIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDFNFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP

TABLE V.8-continued

LbCas12a(E795L)-Linker-mCherry Chimeras

DNPKKTTTLSYDVYKDKRESEDQYLLHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVFDWEEVCLTSAYKELFNKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
XPXPXPXP*MVSKGEEDNMAIIKEFMRFKVHMEGSVNGHEFEIEGEGEGRPYEGTQTAKLKVTKGGPLPFAWDILSP
QFMYGSKAYVKHPADIPDYLKLSFPEGFKWERVMNFEDGGVVTVTQDSSLQDGEFIYKVKLRGTNFPSDGPVMQKK
TMGWEASSERMYPEDGALKGEIKQRLKLKDGGHYDAEVKTTYKAKKPVQLPGAYNVNIKLDITSHNEDYTIVEQYE
RAEGRHSTGGMDELYK*

SEQ ID NO: 299
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSFNGFTTAFTGF
FDNRENMFSEEAKSTSIAFRCINENLTRYISNMDIFEKVDAIFDKHEVQEIKEKILNSDYDVEDFFEGEFFNFVLTQ
EGIDVYNAIIGGFVTESGEKIKGLNEYINLYNQKTKQLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDFNFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYLLHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVFDWEEVCLTSAYKELFNKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
XPXPXPXPXP*MVSKGEEDNMAIIKEFMRFKVHMEGSVNGHEFEIEGEGEGRPYEGTQTAKLKVTKGGPLPFAWDIL
SPQFMYGSKAYVKHPADIPDYLKLSFPEGFKWERVMNFEDGGWTVTQDSSLQDGEFIYKVKLRGTNFPSDGPVMQ
KKTMGWEASSERMYPEDGALKGEIKQRLKLKDGGHYDAEVKTTYKAKKPVQLPGAYNVNIKLDITSHNEDYTIVEQ
YERAEGRHSTGGMDELYK*

SEQ ID NO: 300
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSFNGFTTAFTGF
FDNRENMESEEAKSTSIAFRCINENLTRYISNMDIFEKVDAIFDKHEVQEIKEKILNSDYDVEDFFEGEFFNFVLTQ
EGIDVYNAIIGGFVTESGEKIKGLNEYINLYNQKTKQLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYLLHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVFDWEEVCLTSAYKELFNKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
XPXPXPXP*MVSKGEEDNMAIIKEFMRFKVHMEGSVNGHEFEIEGEGEGRPYEGTQTAKLKVTKGGPLPFAWD
ILSPQFMYGSKAYVKHPADIPDYLKLSFPEGFKWERVMNFEDGGVVTVTQDSSLQDGEFIYKVKLRGTNFPSDGPV
MQKKTMGWEASSERMYPEDGALKGEIKQRLKLKDGGHYDAEVKTTYKAKKPVQLPGAYNVNIKLDITSHNEDYTIV
EQYERAEGRHSTGGMDELYK*

SEQ ID NO: 301
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSFNGETTAFTGF
FDNRENMFSEEAKSTSIAFRCINENLTRYISNMDIFEKVDAIFDKHEVQEIKEKILNSDYDVEDFFEGEFFNEVLTQ
EGIDVYNAIIGGFVTESGEKIKGLNEYINLYNQKTKQLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYLLHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVFDWEEVCLTSAYKELFNKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
XPXPXPXPXPXP*MVSKGEEDNMAIIKEFMRFKVHMEGSVNGHEFEIEGEGEGRPYEGTQTAKLKVTKGGPLPFA
WDILSPQFMYGSKAYVKHPADIPDYLKLSFPEGFKWERVMNFEDGGVVTVTQDSSLQDGEFIYKVKLRGTNFPSDG
PVMQKKTMGWEASSERMYPEDGALKGEIKQRLKIKDGGHYDAEVKTTYKAKKPVQLPGAYNVNIKLDITSHNEDYT
IVEQYERAEGRHSTGGMDELYK*

TABLE V.8-continued

LbCas12a(E795L)-Linker-mCherry Chimeras

SEQ ID NO: 302
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSFNGFTTAFTGF
FDNRENMFSEEAKSTSIAFRCINENLTRYISNMDIFEKVDAIFDKHEVQEIKEKILNSDYDVEDFFEGEFFNEVLTQ
EGIDVYNAIIGGFVTESGEKIKGLNEYINLYNQKTKQLPKFKPLYKQVLSDRESLSFYGEGYTSDEEVLEVFRNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDFNFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKTTTLSYDVYKDKRFSEDQYLLHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNFKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVFDWEEVCLTSAYKELFNKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
XPXPXPXPXPXPXPXPXP*MVSKGEEDNMAIIKEFMRFKVHMEGSVNGHEFEIEGEGEGRPYEGTQTAKLKVTKGGPLP*
*FAWDILSPQFMYGSKAYVKHPADIPDYLKLSFPEGFKWERVMNFEDGGVVTVTQDSSLQDGEFIYKVKLRGTNFPS*
*DGPVMQKKTMGWEASSERMYPEDGALKGEIKQRLKLKDGGHYDÆEVKTTYKAKKPVQLPGAYNVNIKLDITSHNED*
*YTIVEQYERAEGRHSTGGMDELYK*

SEQ ID NO: 303
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSFNGFTTAFTGF
FDNRENMFSEEAKSTSIAFRCINENLTRYISNMDIFEKVDAIFDKHEVQEIKEKILNSDYDVEDFFEGEFFNEVLTQ
EGIDVYNAIIGGFVTESGEKIKGLNEYINLYNQKTKQLPKFKPLYKQVLSDRESLSFYGEGYTSDEEVLEVFRNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDFNFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKTTTLSYDVYKDKRFSEDQYLLHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELFNKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
XPXPXPXPXPXPXPXPXP*MVSKGEEDNMAIIKEFMRFKVHMEGSVNGH*EFEIEGEGEGRPYEGTQTAKLKVTKGGP
*LPFAWDILSPQFMYGSKAYVKHPADIPDYLKLSFPEGFKWER*VMNFEDGVVTVTQDSSLQDGEFIYKVKLRGTNF
*PSDGPVMQKKTMGWEASSERMYPEDGALKGEIKQRLKLKDGGHYDAEVKTTYKAKKPVQLPGAYNVNIKLDITSHN*
*EDYTIVEQYERAEGRHSTGGMDELYK*

SEQ ID NO: 304
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGF
FDNRENMFSEEAKSTSIAFRCINENLTRYISNMDIFEKVDAIFDKHEVQEIKEKILNSDYDVEDFFEGEFFNFVLIQ
EGIDVYNAIIGGFVTESGEKIKGLNEYINLYNQKTKQLPKFKPLYKQVLSDRESLSFYGEGYTSDEEVLEVFRNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYLLHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVFDWEEVCLTSAYKELFNKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH
XPXPXPXPXPXPXPXPXP*MVSKGEEDNMAIIKEFMRFKVHMEGSVNGHEFEIEGEGEGRPYEGTQTAKLKVTKG*
*GPLPFAWDILSPQFMYGSKAYVKHPADIPYLKLSFPEGFKWERVMNFEDGVVTVTQDSSLQDGEFIYKVKLRGT*
*NFPSDGPVMQKKTMGWEASSERMYPEDGALKGEIKQRLKLKDGGHYDAEVKTTYKAKKPVQLPGAYNVNIKLDITS*
*HNEDYTIVEQYERAEGRHSTGGMDELYK*

SEQ ID NO: 305
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSFNGFTTAFTGF
FDNRENMESEEAKSTSIAFRCINENLTRYISNMDIFEKVDAIFDKHEVQEIKEKILNSDYDVEDFFEGEFFNFVLTQ
EGIDVYNAIIGGFVTESGEKIKGLNEYINLYNQKTKQLPKFKPLYKQVLSDRESLSFYGEGYTSDEEVLEVFRNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE

TABLE V.8-continued

LbCas12a(E795L)-Linker-mCherry Chimeras

TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDFNFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKTTTLSYDVYKDKRFSEDQYLLHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSSFDRIMYVPEEDLFEFALDYKNFSRTDADYIKKWKLYSYGNRIRIFRNP
KKNNVFDWEEVCLTSAYKELFNKYGINYQQGDIRALLCEQSDKAFYSSFMALMSLMQMRNSITGRTDVDFLISPVK
NSDGIFYDSRNYEAQENAILPKNADANGAYNIARKVLWAIGQFKKAEDEKLDKVKIAISNKEWLEYAQTSVKH
XPXPXPXPXPXPXPXPXPXPXP*MVSKGEEDNMAIIKEFMRFKVHMEGSVNGHEFEIEGEGEGRPYE*
*KGGPLPFAWDILSPQFMYGSKAYVKHPADIPDYLKLSFPEGFKWERVMNFEDGGVVTVTQDSSLQDGEFIYKVKLR*
*GTNFPSDGPVMQKKTMGWEASSERMYPEDGALKGEIKQRLKLKDGGHYDAEVKTTYKAKKPVQLPGAYNVNIKLDI*
*TSHNEDYTIVEQYERAEGRHSTGGMDELYK*

SEQ ID NO: 306
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGE
FDNRENMESEEAKSTSIAFRCINENLTRYISNMDIFEKVDAIFDKHEVQEIKEKILNSDYDVEDFFEGEFFNFVLTQ
EGIDVYNAIIGGFVTESGEKIKGLNEYINLYNQKTKQKLPKFKPLYKQVLSDRESLSFYGEGYTSDEEVLEVFRNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRFSEDQYLLHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMQMRNSITGRTDVDFLISPVK
NSDGIFYDSRNYEAQENAILPKNADANGAYNIARKVLWAIGQFKKAEDEKLDKVKIAISNKEWLEYAQTSVKH
XPXPXPXPXPXPXPXPXPXPXP*MVSKGEEDNMAIIKEFMRFKVHMEGSVNGHEFEIEGEGEGRPYEGTQTAKLK*
*VTKGGPLPFAWDILSPQFMYGSKAYVKHPADIPDYLKLSFPEGFKWERVMNFEDGGVVTVTQDSSLQDGEFIYKVK*
*LRGTNFPSDGPVMQKKTMGWEASSERMYPEDGALKGEIKQRLKLKDGGHYDAEVKTTYKAKKPVQLPGAYNVNIKL*
*DITSHNEDYTIVEQYERAEGRHSTGGMDELYK*

SEQ ID NO: 307
MSKLEKFTNCYSLSKTLRFKAIPVGKTQENIDNKRLLVEDEKRAEDYKGVKKLLDRYYLSFINDVLHSIKLKNLNNY
ISLERKKTRTEKENKELENLEINLRKEIAKAFKGNEGYKSLFKKDIIETILPEFLDDKDEIALVNSENGETTAFTGF
FDNRENMFSEEAKSTSIAFRCINENLTRYISNMDIFEKVDAIFDKHEVQEIKEKILNSDYDVEDFFEGEFFNFVLTQ
EGIDVYNAIIGGFVTESGEKIKGLNEYINLYNQKTKQKLPKFKPLYKQVLSDRESLSFYGEGYISDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDFNFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKTTTLSYDVYKDKRFSEDQYLLHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVFDWEEVCLTSAYKELFNKYGINYQQGDIRALLCEQSDKAFYSSFMALMSLMQMRNSITGRTDVDFLISPVK
NSDGIFYDSRNYEAQENAILPKNADANGAYNIARKVLWAIGQFKKAEDEKLDKVKIAISNKEWLEYAQTSVKH
XPXPXPXPXPXPXPXPXPXPX*MVSKGEEDNMAIIKEFMRFKVHMEGSVNGHEFEIEGEGEGRPYEGTQTAK*
*LKVTKGGPLPFAWDILSPQFMYGSKAYVKHPADIPDYLKSFPEGFKWERVMNFEDGVVTVTQDSSLQDGEFIYK*
*VKLRGTNFPSDGPVMQKKTMGWEASSERMYPEDGALKGEIKQRLKLKDGGHYDAEVKTTYKAKKPVQLPGAYNVNI*
*KLDITSHNEDYTIVEQYERAEGRHSTGGMDELYK*

SEQ ID NO: 308
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSFNGFTTAFTGF
FDNRENMFSEEAKSTSIAFRCINENLTRYISNMDIFEKVDAIFDKHEVQEIKEKILNSDYDVEDFFEGEFFNFVLTQ
EGIDVYNAIIGGFVTESGEKIKGLNEYINLYNQKTKQKLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDFNFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKTTTLSYDVYKDKRFSEDQYLLHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVFDWEEVCLTSAYKELFNKYGINYQQGDIRALLCEQSDKAFYSSFMALMSLMQMRNSITGRTDVDFLISPVK
NSDGIFYDSRNYEAQENAILPKNADANGAYNIARKVLWAIGQFKKAEDEKLDKVKIAISNKEWLEYAQTSVKH

TABLE V.8-continued

LbCas12a(E795L)-Linker-mCherry Chimeras

XPXPXPXPXPXPXPXPXPXPXPXPXPXP*MVSKGEEDNMAIIKEFMRFKVHMEGSVNGHEFEIEGEGEGRPYEGTQT*
*AKLKVTKGGPLPFAWDILSPQFMYGSKAYVKHPADIPDYLKLSFPEGFKWERVMNFEDGGVVTVTQDSSLQDGEFI*
*YKVKLRGTNFPSDGPVMQKKTMGWEASSERMYPEDGALKGEIKQRLKLKDGGHYDAEVKTTYKAKKPVQLPGAYNV*
*NIKLDITSHNEDYTIVEQYERAEGRHSTGGMDELYK*

SEQ ID NO: 309
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSFNGFTTAFTGF
FDNRENMFSEEAKSTSIAFRCINENLTRYISNMDIFEKVDAIFDKHEVQEIKEKILNSDYDVEDFFEGEFFNFVLTQ
EGIDVYNAIIGGFVTESGEKIKGLNEYINLYNQKTKQKLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDFNFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKTTTLSYDVYKDKRESEDQYLLHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVFDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH

GGGGSEAAAKGGGGS*MVSKGEEDNMAIIKEFMRFKVHMEGSVNGHEFEIEGEGEGRPYEGTQTAKLKVTKGGPLPF*
*AWDILSPQFMYGSKAYVKHPADIPDYLKLSFPEGFKWERVMNFEDGGVVTVTQDSSLQDGEFIYKVKLRGTNFPSD*
*GPVMQKKTMGWEASSERMYPEDGALKGEIKQRLKLKDGGHYDA*EVKTTYKAKKPVQLPGAYNVNIKLDITSHNEDY
TIVEQYERAEGRHSTGGMDELYK

---

Table V.9 provides the LbCas12a protein variant (E795L) amino acid sequence.

TABLE V.9

LbCas12a protein variant (E795L) amino acid sequence.

SEQ ID NO: 310 (LbCas12a (E795L) Protein)
MSKLEKFTNCYSLSKTLRFKAIPVGKTQENIDNKRLLVEDEKRAEDYKGV
KKLLDRYYLSFINDVLHSIKLKNLNNYISLFRKKTRTEKENKELENLEIN
LRKEIAKAFKGNEGYKSLFKKDIIETILPEFLDDKDEIALVNSENGETTA
FTGFFDNRENMESEEAKSTSIAFRCINENLTRYISNMDIFEKVDAIFDKH
EVQEIKEKILNSDYDVEDFFEGEFFNEVLTQEGIDVYNAIIGGFVTESGE
KIKGLNEYINLYNQKTKQKLPKFKPLYKQVLSDRESLSFYGEGYTSDEEV
LEVFRNTLNKNSEIFSSIKKLEKLFKNFDEYSSAGIFVKNGPAISTISKD
IFGEWNVIRDKWNAEYDDIHLKKKAVVTEKYEDDRRKSFKKIGSFSLEQL
QEYADADLSVVEKLKEIIIQKVDEIYKVYGSSEKLFDADFVLEKSLKKND
AVVAIMKDLLDSVKSFENYIKAFFGEGKETNRDESFYGDFVLAYDILLKV
DHIYDAIRNYVTQKPYSKDKFKLYFQNPQFMGGWDKDKETDYRATILRYG
SKYYLAIMDKKYAKCLQKIDKDDVNGNYEKINYKLLPGPNKMLPKVFFSK
KWMAYYNPSEDIQKIYKNGTFKKGDMFNLNDCHKLIDFFKDSISRYPKWS NAYDFNFSETEKYKDIAGFYREVEEQGYKVSFESASKKEVDKLVEEGKLY
MFQIYNKDFSDKSHGTPNLHTMYFKLLFDENNHGQIRLSGGAELFMRRAS
LKKEELVVHPANSPIANKNPDNPKKTTTLSYDVYKDKRFSEDQYLLHIPI
AINKCPKNIFKINTEVRVLLKHDDNPYVIGIDRGERNLLYIVVVDGKGNI
VEQYSLNEIINNFNGIRIKTDYHSLLDKKEKERFEARQNWTSIENIKELK
AGYISQVVHKICELVEKYDAVIALEDLNSGFKNSRVKVEKQVYQKFEKML
IDKLNYMVDKKSNPCATGGALKGYQITNKFESFKSMSTQNGFIFYIPAWL
TSKIDPSTGFVNLLKTKYTSIADSKKFISSFDRIMYVPEEDLFEFALDYK
NFSRTDADYIKKWKLYSYGNRIRIFRNPKKNNVFDWEEVCLTSAYKELFN
KYGINYQQGDIRALLCEQSDKAFYSSFMALMSLMLQMRNSITGRTDVDFL
ISPVKNSDGIFYDSRNYEAQENAILPKNADANGAYNIARKVLWAIGQFKK
AEDEKLDKVKIAISNKEWLEYAQTSVKH

---

Table V.10 provides chimera fusion proteins between Cas protein amino acid sequences to either eGFP or mCherry amino acid sequences (bolded, italicized) without an intervening linker polypeptide.

TABLE V.10

Cas Protein-Fluorescent Protein Chimeras

SEQ ID NO: 311 (Cas9 Protein-eGFP)
MDKKYSIGLDIGTNSVGWAVITDEYKVPSKKFKVLGNTDRHSIKKNLIGALLFDSGETAEATRLKRTARRRYTRRK
NRICYLQEIFSNEMAKVDDSFFHRLEESFLVEEDKKHERHPIFGNIVDEVAYHEKYPTIYHLRKKLVDSTDKADLR
LIYLALAHMIKFRGHFLIEGDLNPDNSDVDKLFIQLVQTYNQLFEENPINASGVDAKAILSARLSKSRRLENLIAQ
LPGEKKNGLFGNLIALSLGLTPNFKSNFDLAEDAKLQLSKDTYDDDLDNLLAQIGDQYADLFLAAKNLSDAILLSD TABLE V.10-continued Cas Protein-Fluorescent Protein Chimeras ILRVNTEITKAPLSASMIKRYDEHHQDLTLLKALVRQQLPEKYKEIFFDQSKNGYAGYIDGGASQEEFYKFIKPIL
EKMDGTEELLVKLNREDLLRKQRTFDNGSIPHQIHLGELHAILRRQEDFYPFLKDNREKIEKILTFRIPYYVGPLA
RGNSRFAWMTRKSEETITPWNFEEVVDKGASAQSFIERMTNFDKNLPNEKVLPKHSLLYEYFTVYNELTKVKYVTE
GMRKPAFLSGEQKKAIVDLLFKINRKVIVKQLKEDYFKKIECFDSVEISGVEDRFNASLGTYHDLLKIIKDKDFLD
NEENEDILEDIVLTLTLFEDREMIEERLKTYAHLFDDKVMKQLKRRRYTGWGRLSRKLINGIRDKQSGKTILDFLK
SDGFANRNFMQLIHDDSLTFKEDIQKAQVSGQGDSLHEHIANLAGSPAIKKGILQTVKVVDELVKVMGRHKPENIV
IEMARENQTTQKGQKNSRERMKRIEEGIKELGSQILKEHPVENTQLQNEKLYLYYLQNGRDMYVDQELDINRLSDY
DVDHIVPQSFLKDDSIDNKVLTRSDKNRGKSDNVPSEEVVKKMKNYWRQLLNAKLITQRKFDNLIKAERGGLSELD
KAGFIKRQLVETRQITKHVAQILDSRMNTKYDENDKLIREVKVITLKSKLVSDERKDFQFYKVREINNYHHAHDAY
LNAVVGTALIKKYPKLESEFVYGDYKVYDVRKMIAKSEQEIGKATAKYFFYSNIMNFFKTEITLANGEIRKRPLIE
TNGETGEIVWDKGRDFATVRKVLSMPQVNIVKKTEVQTGGFSKESILPKRNSDKLIARKKDWDPKKYGGFDSPTVA
YSVLVVAKVEKGKSKKLKSVKELLGITIMERSSFEKNPIDFLEAKGYKEVKKDLIIKLPKYSLFELENGRKRMLAS
AGELQKGNELALPSKYVNFLYLASHYEKLKGSPEDNEQKQLFVEQHKHYLDEIIEQISEFSKRVILADANLDKVLS
AYNKHRDKPIREQAENIIHLFTLINLGAPAAFKYFDTTIDRKRYTSTKEVLDATLIHQSITGLYETRIDLSQLGGD
*MVSKGEEELFTGVVPILVELDGDVNGHKFSVSGEGEGDAT*GKLTLKFICTTGKLPVPWPTLVTTLTYGVQCFSRYP
*DHMKQHDFFKSAMPEGYVQERTIFFKDDGNYKTRAEVKFE*GDTLVNRIELKGIDFKEDGNILGHKLEYNYNSHNVY
*IMADKQKNGIKVNFKIRHNIEDGSVQLADHYQQNTPIGDGP*VLLPDNHYLSTQSALSKDPNEKRDHMVLLEFVTAA
*GITLGMDELYK*

SEQ ID NO: 312 (AsCas12a Protein-eGFP)
MTQFEGFTNLYQVSKTLRFELIPQGKTLKHIQEQGFIEEDKARNDHYKELKPIIDRIYKTYADQCLQLVQLDWENLS
AAIDSYRKEKTEETRNALIEEQATYRNAIHDYFIGRIDNLTDAINKHAEIYKGLFKAELFNGKVLKQLGTVTTTEH
ENALLRSFDKETTYFSGFYENRKNVFSAEDISTAIPHRIVQDNFPKFKENCIFTRLITAVPSLREHFENVKKAIGI
FVSTSIEEVFSFPPFYNQLLTQTQIDLYNQLLGGISREAGTEKIKGLNEVLNLAIQKNDETAHIIASLPHRFIPLFKQ
ILSDRNTLSFILEEFKSDEEVIQSFCKYKTLLRNENVLETAEALFNELNSIDLTHIFISHKKLETISSALCDHWDTL
RNALYERRISELTGKITKSAKEKVQRSLKHEDINLQEIISAAGKELSEAFKQKTSEILSHAHAALDQPLPTTLKKQE
EKEILKSQLDSLLGLYHLLDWFAVDESNEVDPEFSARLTGIKLEMEPSLSFYNKARNYATKKPYSVEKFKLNFQMPT
LASGWDVNKEKNNGAILFVKNGLYYLGIMPKQKGRYKALSFEPTEKTSEGFDKMYYDYFPDAAKMIPKCSTQLKAVT
AHFQTHTTPILLSNNFIEPLEITKEIYDLNNPEKEPKKFQTAYAKKTGDQKGYREALCKWIDFTRDFLSKYTKTTSI
DLSSLRPSSQYKDLGEYYAELNPLLYHISFQRIAEKEIMDAVETGKLYLFQIYNKDFAKGHHGKPNLHTLYWTGLFS
PENLAKTSIKLNGQAELFYRPKSRMKRMAHRLGEKMLNKKLKDQKTPIPDTLYQELYDVVNHRLSHDLSDEARALLP
NVITKEVSHEIIKDRRFTSDKEFFHVPITLNYQAANSPSKFNQRVNAYLKEHPETPIIGIDRGERNLIYITVIDSTG
KILEQRSLNTIQQFDYQKKLDNREKERVAARQAWSVVGTIKDLKQGYLSQVIHEIVDLMIHYQAVVVLENLNFGFKS
KRTGIAEKAVYQQFEKMLIDKLNCLVLKDYPAEKVGGVLNPYQLTDQFTSFAKMGTQSGFLFYVPAPYTSKIDPLTG
FVDPFVWKTIKNHESRKHFLEGFDFLHYDVKTGDFILHFKMNRNLSFQRGLPGEMPAWDIVFEKNETQFDAKGTPFI
AGKRIVPVIENHRFTGRYRDLYPANELIALLEEKGIVFRDGSNILPKLLENDDSHAIDTMVALIRSVLQMRNSNAAT
GEDYINSPVRDLNGVCFDSRFQNPEWPMDADANGAYHIALKGQLLLNHLKESKDLKLQNGISNQDWLAYIQELRN*MV
SKGEEDNMAIIKEFMRFKVHMEGSVNGHEFEIEGE*GEGRPYEGTQTAKLKVTKGGPLPFAWDILSPQFMYGSKAYVK
HPADIPDYLKLSFPEGFKWERVMNFEDGGVVTVTQ*ISSLQDGEFIYKVKLRGTNFPSDGPVMQKKTMGWEASSERMY
PEDGALKGEIKQRLKLKDGGHYDAEVKTTYKAKKPVQLP*GAYNVNIKLDITSHNEDYTIVEQYERAEGRHSTGGMDE
LYK*

SEQ ID NO: 313 (LbCas12a Protein-eGFP)
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGF
FDNRENMESEEAKSTSIAFRCINENLTRYISNMDIFEKVDAIFDKHEVQEIKEKILNSDYDVEDFFEGEFFNEVLTQ
EGIDVYNAIIGGFVTESGEKIKGLNEYINLYNQKTKQLPKFKPLYKQVLSDRESLSFYGEGYTSDEEVLEVFRNTL
NKNSEIFSSIKKLEKLFKNFDEYSSAGIFVKNGPAISTISKDIFGEWNIVRDKWNAEYDDIHLKKKAVVTEKYEDDR
RKSFKKIGSFSLEQLQEYADADLSVVEKLKEIIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRFSEDQYELHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVFDWEEVCLTSAYKELFNKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH*MVSK
GEEELFTGVVPILVELDGDVNGHKFSVSGEGEGDATYGKLTLKFICTTGKLPVPWPTLVTTLTYGVQCFSRYPDHMKQ
HDFFKSAMPEGYVQERTIFFKDDGNYKTRAEVKFEGDTLVNRIELKGIDFKEDGNILGHKLEYNYNSHNVYIMADKQ
KNGIKVNFKIRHNIEDGSVQLADHYQQNTPIGDGPVLLPDNHYLSTQSALSKDPNEKRDHMVLLEFVTAAGITLGMD
ELYK*

SEQ ID NO: 314 (LbCas12a (E795L) Protein-eGFP)
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSENGETTAFTGF
FDNRENMESEEAKSTSIAFRCINENLTRYISNMDIFEKVDAIFDKHEVQEIKEKILNSDYDVEDFFEGEFFNFVLTQ
EGIDVYNAIIGGFVTESGEKIKGLNEYINLYNQKTKQLPKFKPLYKQVLSDRESLSFYGEGYTSDEEVLEVERNTL
NKNSEIFSSIKKLEKLFKNFDEYSSAGIFVKNGPAISTISKDIFGEWNIVRDKWNAEYDDIHLKKKAVVTEKYEDDR
RKSFKKIGSFSLEQLQEYADADLSVVEKLKEIIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDFNFSETEKYKDIAGFYREVEEQGYKVSFESASKKEVDKL TABLE V.10-continued Cas Protein-Fluorescent Protein Chimeras VEEGKLYMFQIYNKDFSDKSHGTPNLHTMYFKLLFDENNHGQIRLSGGAELFMRRASLKKEELVVHPANSPIANKNP
DNPKKTTTLSYDVYKDKRESEDQYLLHIPIAINKCPKNIFKINTEVRVLLKHDDNPVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQPFKKAEDEKLDKVKIAISNKEWLEYAQTSVKH*MVSK*
*GEELFTGVVPILVELDGDVNGHKFSVSGEGEGDATYGKLTLKFICTTGKLPVPWPTLVTTLTYGVQCFSRYPDHMKQ*
*HDFFKSAMPEGYVQERTIFFKDDGNYKTRAEVKFEGDTLVNRIELKGIDFKEDGNILGHKLEYNYNSHNVYIMADKQ*
*KNGIKVNFKIRHNIEDGSVQLADHYQQNTPIGDGPVLLPDNHYLSTQSALSKDPNEKRDHMVLLEFVTAAGITLGMD*
*ELYK*

SEQ ID NO: 315 (Cas9 Protein-mCherry)
MDKKYSIGLDIGTNSVGWAVITDEYKVPSKKFKVLGNTDRHSIKKNLIGALLFDSGETAEATRLKRTARRRYTRRK
NRICYLQEIFSNEMAKVDDSFFHRLEESFLVEEDKKHERHPIFGNIVDEVAYHEKYPTIYHLRKKLVDSTDKADLR
LIYLALAHMIKFRGHFLIEGDLNPDNSDVDKLFIQLVQTYNQLFEENPINASGVDAKAILSARLSKSRRLENLIAQ
LPGEKKNGLFGNLIALSLGLIPNFKSNFDLAEDAKLQLSKDTYDDDLDNLLAQIGDQYADLFLAAKNLSDAILLSD
ILRVNTEITKAPLSASMIKRYDEHHQDLTLLKALVRQQLPEKYKEIFFDQSKNGYAGYIDGGASQEEFYKFIKPIL
EKMDGTEELLVKLNREDLLRKQRTFDNGSIPHQIHLGELHAILRRQEDFYPFLKDNREKIEKILTFRIPYYVGPLA
RGNSRFAWMTRKSEETITPWNFEEVVDKGASAQSFIERMTNFDKNLPNEKVLPKHSLLYEYFTVYNELTKVKYVTE
GMRKPAFLSGEQKKAIVDLLFKINRKVTVKQLKEDYFKKIECFDSVEISGVEDRFNASLGTYHDLLKIIKDKDFLD
NEENEDILEDIVLTLFEDREMIEERLKTYAHLFDDKVMKQLKRRRYTGWGRLSRKLINGIRDKQSGKTILDFLK
SDGFANRNFMQLIHDDSLTFKEDIQKAQVSGQGDSLHEHIANLAGSPAIKKGILQTVKVVDELVKVMGRHKPENIV
IEMARENQTTQKGQKNSRERMKRIEEGIKELGSQILKEHPVENTQLQNEKLYLYYLQNGRDMYVDQELDINRLSDY
DVDHIVPQSFLKDDSIDNKVLTRSDKNRGKSDNVPSEEVVKKMKNYWRQLLNAKLITQRKFDNLTKAERGGLSELD
KAGFIKRQLVETRQITKHVAQILDSRMNTKYDENDKLIREVKVITLKSKLVSDFRKDFQFYKVREINNYHHAHDAY
LNAVVGTALIKKYPKLESEFVYGDYKVYDVRKMIAKSEQEIGKATAKYFFYSNIMNFFKTEITLANGEIRKRPLIE
TNGETGEIVWDKGRDFATVRKVLSMPQVNIVKKTEVQTGGFSKESILPKRNSDKLIARKKDWDPKKYGGFDSPTVA
YSVLVVAKVEKGKSKKLKSVKELLGITIMERSSFEKNPIDFLEAKGYKEVKKDLIIKLPKYSLFELENGRKRMLAS
AGELQKGNELALPSKYVNFLYLASHYEKLKGSPEDNEQKQLFVEQHKHYLDEIIEQISEFSKRVILADANLDKVLS
AYNKHRDKPIREQAENIIHLFTLTNLGAPAAFKYFDTTIDRKRYTSTKEVLDATLIHQSITGLYETRIDLSQLGGD
*MVSKGEEDNMAIIKEFMRFKVHMEGSVNGHEFEIEGEGEGR* YVKHPADIPDYLKLSFPEGFKWERVMNFEDGGVVTVTQDSS
*YVKHPADIPDYLKLSFPEGFKWERVMNFEDGGVVTVTQDSS* LQDGEFIYKVKLRGTNFPSDGPVMQKKTMGWEASS
ERMYPEDGALKGEIKQRLKLKDGGHYDAEVKTTYKAKKPVQ *PGAYNVNIKLDITSHNEDYTIVEQYERAEGRHST*
*GGMDELYK*

SEQ ID NO: 316 (AsCas12a Protein-mCherry)
MTQFEGFTNLYQVSKTLRFELIPQGKTLKHIQEQGFIEEDKARNDHYKELKPIIDRIYKTYADQCLQLVQLDWENLS
AAIDSYRKEKTEETRNALIEEQATYRNAIHDYFIGRTDNLTDAINKRHAEIYKGLFKAELFNGKVLKQLGTVTTTEH
ENALLRSFDKETTYFSGFYENRKNVESAEDISTAIPHRIVQDNFPKEKENCHIFTRLITAVPSLREHFENVKKAIGI
FVSTSIEEVFSFPFYNQLLTQTQIDLYNQLLGGISREAGTEKIKGLNEVLNLAIQKNDETAHIIASLPHRFIPLFKQ
ILSDRNTLSFILEEFKSDEEVIQSFCKYKTLLRNENVLETAAEALFNELNSIDLTHIFISHKKLETISSALCDHWDTL
RNALYERRISELTGKITKSAKEKVQRSLKHEDINLQEIISAAGKELSEAFKQKTSEILSHAHAALDQPLPTTLKKQE
EKEILKSQLDSLLGLYHLLDWFAVDESNEVDPEFSARLTGIKLEMEPSLSFYNKARNYATKKPYSVEKFKLNFQMPT
LASGWDVNKEKNNGAILFVKNGLYYLGIMPKQKGRYKALSFEPTEKTSEGFDKMYYDYFPDAAKMIPKCSTQLKAVT
AHFQTHTTPILLSNNFIEPLEITKEIYDLNNPEKEPKKFQTAYAKKTGDQKGYREALCKWIDFTRDPFLSKYTKTTSI
DLSSLRPSSQYKDLGEYYAELNPLLYHISFQRIAEKEIMDAVETGKLYLFQIYNKDFAKGHHGKPNLHTLYWTGLFS
PENLAKTSIKLNGQAELFYRPKSRMKRMAHRLGEKMLNKKLKDQKTPIPDTLYQELYDYVNHRLSHDLSDEARALLP
NVITKEVSHEIIKDRRFTSDKEFFHVPITLNYQAANSPSKFNQRVNAYLKEHPETPIIGIDRGERNLIYITVIDSTG
KILEQRSLNTIQQFDYQKKLDNREKERVAARQAWSVVGTIKDLKQGYLSQVIHEIVDLMIHYQAVVVLENLNFGFKS
KRTGIAEKAVYQQFEKMLIDKLNCLVLKDYPAEKVGGVLNPYQLTDQFTSFAKMGTQSGELFYVPAPYTSKIDPLTG
FVDPFVWKTIKNHESRKHFLEGFDFLHYDVKTGDFILHFKMNRNLSFQRGLPGEMPAWDIVFEKNETQFDAKGTPFI
AGKRIVPVIENHRFTGRYRDLYPANELIALLEEKGIVFRDGSNILENDDSHAIDTMVALIRSVLQMRNSNAAT
GEDYINSPVRDLNGVCFDSRFQNPEWPMDADANGAYHIALKGQLLLNHLKESKDLKLQNGISNQDWLAYIQELRK*MV*
*SKGEEDNMAIIKEFMRFKVHMEGSVNGHEFEIEGEGEGRPYEGT*QTAKLKVTKGGPLPFAWDILSPQFMYGSKAYVK
*HPADIPDYLKLSFPEGFKWERVMNFEDGGVVTVTQDSSLQDGEIIYKVKLRGTNFPSDGPVMQKKTMGWEASSERMY*
*PEDGALKGEIKQRLKLKDGGHYDAEVKTTYKAKKPVQLPGAYNVNIKLDITSHNEDYTIVEQYERAEGRHSTGGMDE*
*LYK*

SEQ ID NO: 317 (LbCas12a Protein-mCherry)
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSFNGFTTAFTGF
FDNRENMESEEAKSTSIAFRCINENLTRYISNMDIFEKVDAIFDKHEVQEIKEKILNSDYDVEDFFEGEFFNFVLTQ
EGIDVYNAIIGGFVTESGEKIKGLNEYINYQNKTKQKLPKFKPLYKQVLSDRESLSFYGEGYTSDEEVLEVFRNTL
NKNSEIFSSIKKLEKLFKNFDEYSSAGIFVKNGPAISTISKDIFGEWNVKHKWNAEYDDIHLKKKAVVTEKYEDDR
RKSFKKIGSFSLEQLQEYADADLSVVEKLKEIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGMDNHCHKLIDFFKDSISRYPKWSNAYDFNFSETEKYKDIAGFYRVNEEQGKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKITTLSYDVYKDKRESEDQYELHIPIAINKCPKNIFKINTEVRVLLKHDDNPVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP TABLE V.10-continued Cas Protein-Fluorescent Protein Chimeras KKNNVEDWEEVCLTSAYKELENKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH*MVSK*
*GEEDNMAIIKEFMRFKVHMEGSVNGHEFEIEGEGEGRPYEGTQTAKLKVTKGGPLPFAWDILSPQFMYGSKAYVKHP*
*ADIPDYLKLSFPEGFKWERVMNFEDGGVVTVTQDSSLQDGEFIYKVKLRGTNFPSDGPVMQKKTMGWEASSERMYPE*
*DGALKGEIKQRLKLKDGGHYDAEVKTTYKAKKPVQLPGAYNVNIKLDITSHNEDYTIVEQYERAEGRHSTGGMDELY*
*K*

SEQ ID NO: 318 (LbCas12a (E795L) Protein-mCherry)
MSKLEKFTNCYSLSKTLRFKAIPVGKTQENIDNKRLLVEDEKRAEDYKGVKKLLDRYYLSFINDVLHSIKLKNLNNY
ISLFRKKTRTEKENKELENLEINLRKEIAKAFKGNEGYKSLFKKDIIETILPEFLDDKDEIALVNSFNGFTTAFTGF
FDNRENMFSEEAKSTSIAFRCINENLTRYISNMDIFEKVDAIFDKHEVQEIKEKILNSDYDVEDFFEGEFFNEVLTQ
EGIDVYNAIIGGFVTESGEKIKGLNEYINLYNQKTKQKLPKFKPLYKQVLSDRESLSFYGEGYTSDEEVLEVERNTL
NKNSEIFSSIKKLEKLFKNFDEYSSAGIFVKNGPAISTISKDIFGEWNVIRDKWNAEYDDIHLKKKAVVTEKYEDDR
RKSFKKIGSFSLEQLQEYADADLSVVEKLKEIIIQKVDEIYKVYGSSEKLFDADFVLEKSLKKNDAVVAIMKDLLDS
VKSFENYIKAFFGEGKETNRDESFYGDFVLAYDILLKVDHIYDAIRNYVTQKPYSKDKFKLYFQNPQFMGGWDKDKE
TDYRATILRYGSKYYLAIMDKKYAKCLQKIDKDDVNGNYEKINYKLLPGPNKMLPKVFFSKKWMAYYNPSEDIQKIY
KNGTFKKGDMFNLNDCHKLIDFFKDSISRYPKWSNAYDENFSETEKYKDIAGFYREVEEQGYKVSFESASKKEVDKL
VEEGKLYMFQIYNKDFSDKSHGTPNLHTMYFKLLFDENNHGQIRLSGGAELFMRRASLKKEELVVHPANSPIANKNP
DNPKKTTTLSYDVYKDKRESEDQYLLHIPIAINKCPKNIFKINTEVRVLLKHDDNPYVIGIDRGERNLLYIVVVDGK
GNIVEQYSLNEIINNFNGIRIKTDYHSLLDKKEKERFEARQNWTSIENIKELKAGYISQVVHKICELVEKYDAVIAL
EDLNSGFKNSRVKVEKQVYQKFEKMLIDKLNYMVDKKSNPCATGGALKGYQITNKFESFKSMSTQNGFIFYIPAWLT
SKIDPSTGFVNLLKTKYTSIADSKKFISSFDRIMYVPEEDLFEFALDYKNFSRTDADYIKKWKLYSYGNRIRIFRNP
KKNNVFDWEEVCLTSAYKELFNKYGINYQQGDIRALLCEQSDKAFYSSFMALMSLMLQMRNSITGRTDVDFLISPVK
NSDGIFYDSRNYEAQENAILPKNADANGAYNIARKVLWAIGQFKKAEDEKLDKVKIAISNKEWLEYAQTSVKH*MVSK*
*GEEDNMAIIKEFMRFKVHMEGSVNGHEFEIEGEGEGRPYEGTOTAKLKVTKGGPLPFAWDILSPQFMYGSKAYVKHP*
*ADIPDYLKLSFPEGFKWERVMNFEDGGVVTVTQDSSLODGEFIYKVKLRGTNFPSDGPVMQKKTMGWEASSERMYPE*
*DGALKGEIKQRLKLKDGGHYDAEVKTTYKAKKPVQLPGAYNVNIKIDITSHNEDYTIVEQYERAEGRHSTGGMDELY*
*K*

Exemplary DNA sequences encoding Cas9 protein chimeras (Wild-type Cas9 protein DNA sequence)
SEQ ID NO: 347
ATGGACAAAAAGTACTCTATTGGCCTGGATATCGGGACCAACAGCGTCGGGTGGGCTGTTATCACCGACGAGTATAA

AGTACCTTCGAAAAAGTTCAAAGTGCTGGGCAACACCGATCGCCATTCAATCAAAAAGAACTTGATTGGTGCGCTGT

TGTTTGACTCCGGGGAAACCGCCGAGGCGACTCGCCTTAAACGTACAGCACGTCGCCGGTACACTCGGCGTAAGAAT

CGCATTTGCTATTTGCAGGAAATCTTTAGCAACGAGATGGCAAAGTCGATGACTCGTTTTTCCACCGCCTCGAGGA

AAGCTTTCTGGTGGAGGAAGACAAAAAGCATGAGCGTCACCCGATCTTCGGCAACATTGTCGATGAAGTAGCGTATC

ATGAAAAATACCCAACCATTTACCACTTACGCAAAAAGCTGGTGGACAGCACTGACAAAGCTGATTTGCGCCTTATC

TATTTAGCCCTGGCACATATGATTAAGTTTCGTGGTCACTTCCTGATCGAAGGAGACTTAAATCCCGACAACAGTGA

TGTTGATAAATTGTTTATTCAGCTTGTCCAAACTTACAATCAACTGTTCGAGGAAAACCCGATCAATGCCTCCGGTG

TGGATGCAAAAGCCATTTTAAGTGCACGCCTTAGCAAGTCCCGTCGCTTAGAAAACCTTATCGCGCAGCTGCCCGGC

GAGAAAAAGAATGGTTTGTTTGGGAACCTTATTGCCTTGAGCTTAGGCCTCACCCCGAATTTCAAAAGTAATTTCGA

TCTTGCAGAAGACGCCAAATTACAACTGTCGAAGGATACTTATGATGACGATCTCGATAATCTGTTAGCGCAGATTG

GTGACCAATACGCCGATCTTTTTCTGGCGGCTAAAAATCTGAGCGACGCCATCTTGCTTTCGGATATTCTCCGCGTT

AACACCGAAATCACGAAAGCGCCTCTTAGTGCCAGCATGATTAAACGTTATGATGAACACCACCAGGACCTGACCTT

ACTCAAAGCGTTGGTTCGCCAGCAACTGCCAGAGAAGTACAAAGAAATCTTCTTTGATCAGTCAAAGAATGGTTATG

CCGGCTATATTGACGGGGGTGCAAGCCAAGAGGAATTCTACAAATTTATCAAGCCTATTCTGGAGAAAATGGATGGC

ACCGAAGAGTTATTGGTGAAGCTTAACCGTGAAGACCTCCTGCGGAAACAGCGCACATTCGATAATGGTTCGATCCC

ACACCAAATCCATTTGGGGAGTTACACGCTATTTTGCGTCGCCAGGAAGACTTTTACCCTTTCCTGAAGGATAACC

GGGAGAAAATTGAGAAGATCCTTACCTTTCGTATTCCGTATTACGTAGGCCCCTTAGCACGGGGTAATAGCCGTTTC

GCGTGGATGACACGGAAGTCGGAAGAGACGATCACCCCGTGGAACTTCGAAGAGGTAGTCGACAAGGGCGCATCAGC

-continued

```
GCAGTCTTTTATTGAACGTATGACGAATTTCGATAAAAACTTGCCCAATGAGAAGGTGCTTCCGAAACATTCCTTGT

TATATGAATATTTTACAGTTTACAACGAGCTGACCAAGGTTAAATACGTGACGGAAGGAATGCGCAAGCCCGCTTTT

CTTAGCGGTGAGCAAAAAAGGCGATCGTCGACCTGTTATTCAAAACGAATCGTAAGGTGACTGTAAAGCAACTCAA

AGAAGATTACTTCAAAAAGATTGAGTGCTTCGACAGCGTCGAAATCTCTGGGGTAGAGGATCGGTTTAACGCAAGTT

TAGGTACCTACCATGACCTGCTTAAAATCATTAAGGATAAAGACTTCTTAGATAATGAAGAGAACGAAGATATTCTC

GAGGACATCGTCTTGACGTTAACCTTATTTGAGGATCGTGAAATGATTGAGGAACGCCTCAAAACTTATGCCCACCT

GTTCGACGATAAGGTGATGAAGCAGCTGAAACGTCGGCGCTACACAGGATGGGGCCGCTTGAGTCGCAAACTTATTA

ACGGAATCCGTGACAAGCAATCCGGCAAAACGATTCTGGATTTCTTGAAGTCGGACGGATTTGCTAATCGCAACTTC

ATGCAGTTGATCCATGATGACTCCCTGACTTTTAAAGAGGATATTCAAAAGGCGCAGGTTAGTGGTCAAGGCGACAG

CTTACACGAACACATCGCAAATTTGGCTGGTTCGCCGGCCATTAAAAAGGGGATCCTCCAGACCGTGAAAGTTGTAG

ATGAGCTTGTTAAGGTCATGGGTCGTCATAAGCCCGAAAACATCGTGATTGAAATGGCGCGGGAGAATCAAACGACC

CAGAAAGGACAAAAGAATAGCCGTGAACGGATGAAGCGGATCGAGGAAGGCATTAAAGAGCTGGGGTCTCAAATCTT

GAAGGAACACCCTGTGGAGAACACTCAGCTCCAAAATGAAAAACTTTACCTGTACTATTTGCAGAACGGACGCGATA

TGTACGTGGACCAAGAGTTGGATATTAATCGGCTGAGTGACTACGACGTTGATCATATCGTCCCGCAGAGCTTCCTC

AAAGACGATTCTATTGACAATAAGGTACTGACGCGCTCTGATAAAAACCGTGGTAAGTCGGACAACGTGCCCTCCGA

AGAGGTTGTGAAAAAGATGAAAAATTATTGGCGCCAGCTTTTAAACGCGAAGCTGATCACACAACGTAAATTCGATA

ATTTGACCAAGGCTGAACGGGGTGGCCTGAGCGAGTTAGATAAGGCAGGATTTATTAAACGCCAGTTAGTGGAGACT

CGTCAAATCACCAAACATGTCGCGCAGATTTTGGACAGCCGGATGAACACCAAGTACGATGAAAATGACAAACTGAT

CCGTGAGGTGAAAGTCATTACTCTGAAGTCCAAATTAGTTAGTGATTTCCGGAAGGACTTTCAATTCTACAAAGTCC

GTGAAATTAATAACTATCATCACGCACATGACGCGTACCTGAATGCAGTGGTTGGGACCGCCCTTATCAAGAAATAT

CCTAAGCTGGAGTCGGAGTTTGTCTATGGCGACTATAAGGTATACGATGTTCGCAAAATGATTGCGAAATCTGAGCA

GGAGATCGGTAAGGCAACCGCAAAATATTTCTTTTACTCAAACATTATGAATTTCTTTAAGACAGAAATCACTCTGG

CCAACGGGGAGATTCGCAAACGTCCGTTGATCGAAACAAACGGCGAGACTGGCGAAATTGTTTGGGACAAAGGGCGT

GATTTCGCGACGGTGCGCAAGGTACTGAGCATGCCTCAAGTCAATATTGTTAAGAAAACCGAAGTGCAGACGGGCGG

GTTTTCCAAGGAAAGCATCTTACCCAAACGTAATTCAGATAAACTTATTGCACGCAAAAAGGACTGGGATCCGAAAA

AGTATGGAGGCTTCGACAGTCCAACCGTAGCCTACTCTGTTCTCGTTGTAGCGAAAGTAGAAAAGGGTAAATCCAAG

AAACTGAAATCTGTCAAGGAGTTGCTTGGAATCACCATTATGGAGCGTAGCTCCTTCGAAGAAACCCGATTGACTT

TCTGGAAGCCAAAGGATATAAAGAGGTCAAGAAAGATCTTATCATTAAGCTGCCTAAGTATTCACTCTTCGAGCTGG

AAAATGGTCGTAAACGCATGCTCGCTTCTGCCGGCGAGTTGCAGAAGGGCAATGAATTAGCACTTCCATCAAAGTAC

GTTAACTTCCTGTATTTGGCCAGCCATTACGAGAAACTGAAGGGGTCTCCAGAGGACAACGAACAGAAACAATTATT

TGTAGAGCAGCACAAGCATTATCTTGATGAAATCATTGAGCAAATTTCCGAATTCAGTAAACGCGTAATCCTGGCCG

ATGCAAACCTCGACAAGGTGCTGAGCGCTTACAATAAGCATCGCGACAAACCTATCCGTGAGCAGGCTGAAAATATC

ATTCACCTGTTCACATTAACGAACCTGGGCGCTCCGGCCGCTTTTAAATATTTCGACACGACAATCGACCGTAAGCG

CTATACCAGTACGAAAGAAGTGTTGGATGCGACCCTTATTCACCAGTCAATTACAGGATTATATGAGACCCGTATCG

ACCTTAGCCAATTAGGTGGGGAT
```

(Cas9-GSAGSAAGSGEF-eGFP chimera DNA sequence)

SEQ ID NO: 348

```
ATGGACAAAAAGTACTCTATTGGCCTGGATATCGGGACCAACAGCGTCGGGTGGGCTGTTATCACCGACGAGTATAA

AGTACCTTCGAAAAAGTTCAAAGTGCTGGGCAACACCGATCGCCATTCAATCAAAAAGAACTTGATTGGTGCGCTGT

TGTTTGACTCCGGGGAAACCGCCGAGGCGACTCGCCTTAAACGTACAGCACGTCGCCGGTACACTCGGCGTAAGAAT

CGCATTTGCTATTTGCAGGAAATCTTTAGCAACGAGATGGCAAAAGTCGATGACTCGTTTTTCCACCGCCTCGAGGA
```

-continued
AAGCTTTCTGGTGGAGGAAGACAAAAAGCATGAGCGTCACCCGATCTTCGGCAACATTGTCGATGAAGTAGCGTATC
ATGAAAAATACCCAACCATTTACCACTTACGCAAAAAGCTGGTGGACAGCACTGACAAAGCTGATTTGCGCCTTATC
TATTTAGCCCTGGCACATATGATTAAGTTTCGTGGTCACTTCCTGATCGAAGGAGACTTAAATCCCGACAACAGTGA
TGTTGATAAATTGTTTATTCAGCTTGTCCAAACTTACAATCAACTGTTCGAGGAAAACCCGATCAATGCCTCCGGTG
TGGATGCAAAAGCCATTTTAAGTGCACGCCTTAGCAAGTCCCGTCGCTTAGAAAACCTTATCGCGCAGCTGCCCGGC
GAGAAAAAGAATGGTTTGTTTGGGAACCTTATTGCCTTGAGCTTAGGCCTCACCCCGAATTTCAAAAGTAATTTCGA
TCTTGCAGAAGACGCCAAATTACAACTGTCGAAGGATACTTATGATGACGATCTCGATAATCTGTTAGCGCAGATTG
GTGACCAATACGCCGATCTTTTTCTGGCGGCTAAAAATCTGAGCGACGCCATCTTGCTTTCGGATATTCTCCGCGTT
AACACCGAAATCACGAAAGCGCCTCTTAGTGCCAGCATGATTAAACGTTATGATGAACACCACCAGGACCTGACCTT
ACTCAAAGCGTTGGTTCGCCAGCAACTGCCAGAGAAGTACAAAGAAATCTTCTTTGATCAGTCAAAGAATGGTTATG
CCGGCTATATTGACGGGGGTGCAAGCCAAGAGGAATTCTACAAATTTATCAAGCCTATTCTGGAGAAAATGGATGGC
ACCGAAGAGTTATTGGTGAAGCTTAACCGTGAAGACCTCCTGCGGAAACAGCGCACATTCGATAATGGTTCGATCCC
ACACCAAATCCATTTGGGGGAGTTACACGCTATTTTGCGTCGCCAGGAAGACTTTTACCCTTTCCTGAAGGATAACC
GGGAGAAAATTGAGAAGATCCTTACCTTTCGTATTCCGTATTACGTAGGCCCCTTAGCACGGGGTAATAGCCGTTTC
GCGTGGATGACACGGAAGTCGGAAGAGACGATCACCCCGTGGAACTTCGAAGAGGTAGTCGACAAGGGCGCATCAGC
GCAGTCTTTTATTGAACGTATGACGAATTTCGATAAAAACTTGCCCAATGAGAAGGTGCTTCCGAAACATTCCTTGT
TATATGAATATTTTACAGTTTACAACGAGCTGACCAAGGTTAAATACGTGACGGAAGGAATGCGCAAGCCCGCTTTT
CTTAGCGGTGAGCAAAAAAGGCGATCGTCGACCTGTTATTCAAAACGAATCGTAAGGTGACTGTAAAGCAACTCAA
AGAAGATTACTTCAAAAAGATTGAGTGCTTCGACAGCGTCGAAATCTCTGGGGTAGAGGATCGGTTTAACGCAAGTT
TAGGTACCTACCATGACCTGCTTAAAATCATTAAGGATAAAGACTTCTTAGATAATGAAGAGAACGAAGATATTCTC
GAGGACATCGTCTTGACGTTAACCTTATTTGAGGATCGTGAAATGATTGAGGAACGCCTCAAAACTTATGCCCACCT
GTTCGACGATAAGGTGATGAAGCAGCTGAAACGTCGGCGCTACACAGGATGGGGCCGCTTGAGTCGCAAACTTATTA
ACGGAATCCGTGACAAGCAATCCGGCAAAACGATTCTGGATTTCTTGAAGTCGGACGGATTTGCTAATCGCAACTTC
ATGCAGTTGATCCATGATGACTCCCTGACTTTTAAAGAGGATATTCAAAAGGCGCAGGTTAGTGGTCAAGGCGACAG
CTTACACGAACACATCGCAAATTTGGCTGGTTCGCCGGCCATTAAAAAGGGGATCCTCCAGACCGTGAAAGTTGTAG
ATGAGCTTGTTAAGGTCATGGGTCGTCATAAGCCCGAAAACATCGTGATTGAAATGGCGCGGGAGAATCAAACGACC
CAGAAAGGACAAAAGAATAGCCGTGAACGGATGAAGCGGATCGAGGAAGGCATTAAAGAGCTGGGGTCTCAAATCTT
GAAGGAACACCCTGTGGAGAACACTCAGCTCCAAAATGAAAAACTTTACCTGTACTATTTGCAGAACGGACGCGATA
TGTACGTGGACCAAGAGTTGGATATTAATCGGCTGAGTGACTACGACGTTGATCATATCGTCCCGCAGAGCTTCCTC
AAAGACGATTCTATTGACAATAAGGTACTGACGCGCTCTGATAAAAACCGTGGTAAGTCGGACAACGTGCCCTCCGA
AGAGGTTGTGAAAAAGATGAAAAATTATTGGCGCCAGCTTTTAAACGCGAAGCTGATCACACAACGTAAATTCGATA
ATTTGACCAAGGCTGAACGGGGTGGCCTGAGCGAGTTAGATAAGGCAGGATTTATTAAACGCCAGTTAGTGGAGACT
CGTCAAATCACCAAACATGTCGCGCAGATTTTGGACAGCCGGATGAACACCAAGTACGATGAAAATGACAAACTGAT
CCGTGAGGTGAAAGTCATTACTCTGAAGTCCAAATTAGTTAGTGATTTCCGGAAGGACTTTCAATTCTACAAAGTCC
GTGAAATTAATAACTATCATCACGCACATGACGCGTACCTGAATGCAGTGGTTGGGACCGCCCTTATCAAGAAATAT
CCTAAGCTGGAGTCGGAGTTTGTCTATGGCGACTATAAGGTATACGATGTTCGCAAAATGATTGCGAAATCTGAGCA
GGAGATCGGTAAGGCAACCGCAAAATATTTCTTTTACTCAAACATTATGAATTTCTTTAAGACAGAAATCACTCTGG
CCAACGGGGAGATTCGCAAACGTCCGTTGATCGAAACAAACGGCGAGACTGGCGAAATTGTTTGGGACAAAGGGCGT
GATTTCGCGACGGTGCGCAAGGTACTGAGCATGCCTCAAGTCAATATTGTTAAGAAAACCGAAGTGCAGACGGGCGG
GTTTTCCAAGGAAAGCATCTTACCCAAACGTAATTCAGATAAACTTATTGCACGCAAAAAGGACTGGGATCCGAAAA
AGTATGGAGGCTTCGACAGTCCAACCGTAGCCTACTCTGTTCTCGTTGTAGCGAAAGTAGAAAAGGGTAAATCCAAG -continued

```
AAACTGAAATCTGTCAAGGAGTTGCTTGGAATCACCATTATGGAGCGTAGCTCCTTCGAGAAGAACCCGATTGACTT

TCTGGAAGCCAAAGGATATAAAGAGGTCAAGAAAGATCTTATCATTAAGCTGCCTAAGTATTCACTCTTCGAGCTGG

AAAATGGTCGTAAACGCATGCTCGCTTCTGCCGGCGAGTTGCAGAAGGGCAATGAATTAGCACTTCCATCAAAGTAC

GTTAACTTCCTGTATTTGGCCAGCCATTACGAGAAACTGAAGGGGTCTCCAGAGGACAACGAACAGAAACAATTATT

TGTAGAGCAGCACAAGCATTATCTTGATGAAATCATTGAGCAAATTTCCGAATTCAGTAAACGCGTAATCCTGGCCG

ATGCAAACCTCGACAAGGTGCTGAGCGCTTACAATAAGCATCGCGACAAACCTATCCGTGAGCAGGCTGAAAATATC

ATTCACCTGTTCACATTAACGAACCTGGGCGCTCCGGCCGCTTTTAAATATTTCGACACGACAATCGACCGTAAGCG

CTATACCAGTACGAAAGAAGTGTTGGATGCGACCCTTATTCACCAGTCAATTACAGGATTATATGAGACCCGTATCG

ACCTTAGCCAATTAGGTGGGGATGGTAGCGCAGGTAGTGCAGCAGGTAGCGGTGAATTTATGGTTAGCAAAGGTGAA

GAACTGTTTACCGGCGTTGTGCCGATTCTGGTGGAACTGGATGGTGATGTGAATGGCCATAAATTTAGCGTTagcGG

CGAAGGCGAAGGTGATGCGACCtatGGTAAACTGACCCTGAAATTTATTTGCACCACCGGTAAACTGCCGGTTCCGT

GGCCGACCCTGGTGACCACCCTGACCTATGGCGTTCAGTGCTTTAGCCGCTATCCGGATCATATGAAAcagCATGAT

TTCTTTAAAAGCGCGATGCCGGAAGGCTATGTGCAGGAACGTACCATTtttTTCAAAGATGATGGCaacTATAAAAC

CCGTGCGGAAGTTAAATTTGAAGGCGATACCCTGGTGAACCGCATTGAACTGAAAGGTATTGATTTTAAAGAAGATG

GCAACATTCTGGGTCATAAACTGGAATATAATtacAACAGCCATAATGTGTATATTatgGCCGATAAACAGAAAAAT

GGCATCAAAgtgAACTTTAAAATCCGTCACAACattGAAGATGGTAGCGTGCAGCTGGCGGATCATTATCAGCAGAA

TACCCCGATTGGTGATGGCCCGGTGCTGCTGCCGGATAATCATTATCTGAGCACCCAGAGCGcgCTGAGCAAAGATC

CGAATGAAAAACGTGATCATATGGTGCTGCTGGAATTTGTTACCGCCGCGGGCATTACCctgGGTATGGATGAACTG

TATAAA
```

(Cas9-(GGGGS)$_4$-eGFP chimera DNA sequence)

SEQ ID NO: 349

```
ATGGACAAAAAGTACTCTATTGGCCTGGATATCGGGACCAACAGCGTCGGGTGGGCTGTTATCACCGACGAGTATAA

AGTACCTTCGAAAAAGTTCAAAGTGCTGGGCAACACCGATCGCCATTCAATCAAAAAGAACTTGATTGGTGCGCTGT

TGTTTGACTCCGGGGAAACCGCCGAGGCGACTCGCCTTAAACGTACAGCACGTCGCCGGTACACTCGGCGTAAGAAT

CGCATTTGCTATTTGCAGGAAATCTTTAGCAACGAGATGGCAAAAGTCGATGACTCGTTTTTCCACCGCCTCGAGGA

AAGCTTTCTGGTGGAGGAAGACAAAAAGCATGAGCGTCACCCGATCTTCGGCAACATTGTCGATGAAGTAGCGTATC

ATGAAAAATACCCAACCATTTACCACTTACGCAAAAAGCTGGTGGACAGCACTGACAAAGCTGATTTGCGCCTTATC

TATTTAGCCCTGGCACATATGATTAAGTTTCGTGGTCACTTCCTGATCGAAGGAGACTTAAATCCCGACAACAGTGA

TGTTGATAAATTGTTTATTCAGCTTGTCCAAACTTACAATCAACTGTTCGAGGAAAACCCGATCAATGCCTCCGGTG

TGGATGCAAAAGCCATTTTAAGTGCACGCCTTAGCAAGTCCCGTCGCTTAGAAAACCTTATCGCGCAGCTGCCCGGC

GAGAAAAAGAATGGTTTGTTTGGGAACCTTATTGCCTTGAGCTTAGGCCTCACCCCGAATTTCAAAAGTAATTTCGA

TCTTGCAGAAGACGCCAAATTACAACTGTCGAAGGATACTTATGATGACGATCTCGATAATCTGTTAGCGCAGATTG

GTGACCAATACGCCGATCTTTTTCTGGCGGCTAAAAATCTGAGCGACGCCATCTTGCTTTCGGATATTCTCCGCGTT

AACACCGAAATCACGAAAGCGCCTCTTAGTGCCAGCATGATTAAACGTTATGATGAACACCACCAGGACCCTGACCTT

ACTCAAAGCGTTGGTTCGCCAGCAACTGCCAGAGAAGTACAAAGAAATCTTCTTTGATCAGTCAAAGAATGGTTATG

CCGGCTATATTGACGGGGGTGCAAGCCAAGAGGAATTCTACAAATTTATCAAGCCTATTCTGGAGAAAATGGATGGC

ACCGAAGAGTTATTGGTGAAGCTTAACCGTGAAGACCTCCTGCGGAAACAGCGCACATTCGATAATGGTTCGATCCC

ACACCAAATCCATTTGGGGAGTTACACGCTATTTTGCGTCGCCAGGAAGACTTTTACCCTTTCCTGAAGGATAACC

GGGAGAAAATTGAGAAGATCCTTACCTTTCGTATTCCGTATTACGTAGGCCCCTTAGCACGGGGTAATAGCCGTTTC

GCGTGGATGACACGGAAGTCGGAAGAGACGATCACCCCGTGGAACTTCGAAGAGGTAGTCGACAAGGGCGCATCAGC

GCAGTCTTTTATTGAACGTATGACGAATTTCGATAAAAACTTGCCCAATGAGAAGGTGCTTCCGAAACATTCCTTGT
```

-continued

```
TATATGAATATTTTACAGTTTACAACGAGCTGACCAAGGTTAAATACGTGACGGAAGGAATGCGCAAGCCCGCTTTT
CTTAGCGGTGAGCAAAAAAGGCGATCGTCGACCTGTTATTCAAAACGAATCGTAAGGTGACTGTAAAGCAACTCAA
AGAAGATTACTTCAAAAAGATTGAGTGCTTCGACAGCGTCGAAATCTCTGGGGTAGAGGATCGGTTTAACGCAAGTT
TAGGTACCTACCATGACCTGCTTAAAATCATTAAGGATAAAGACTTCTTAGATAATGAAGAGAACGAAGATATTCTC
GAGGACATCGTCTTGACGTTAACCTTATTTGAGGATCGTGAAATGATTGAGGAACGCCTCAAAACTTATGCCCACCT
GTTCGACGATAAGGTGATGAAGCAGCTGAAACGTCGGCGCTACACAGGATGGGGCCGCTTGAGTCGCAAACTTATTA
ACGGAATCCGTGACAAGCAATCCGGCAAAACGATTCTGGATTTCTTGAAGTCGGACGGATTTGCTAATCGCAACTTC
ATGCAGTTGATCCATGATGACTCCCTGACTTTTAAAGAGGATATTCAAAAGGCGCAGGTTAGTGGTCAAGGCGACAG
CTTACACGAACACATCGCAAATTTGGCTGGTTCGCCGGCCATTAAAAAGGGGATCCTCCAGACCGTGAAAGTTGTAG
ATGAGCTTGTTAAGGTCATGGGTCGTCATAAGCCCGAAAACATCGTGATTGAAATGGCGCGGGAGAATCAAACGACC
CAGAAAGGACAAAAGAATAGCCGTGAACGGATGAAGCGGATCGAGGAAGGCATTAAAGAGCTGGGGTCTCAAATCTT
GAAGGAACACCCTGTGGAGAACACTCAGCTCCAAAATGAAAAACTTTACCTGTACTATTTGCAGAACGGACGCGATA
TGTACGTGGACCAAGAGTTGGATATTAATCGGCTGAGTGACTACGACGTTGATCATATCGTCCCGCAGAGCTTCCTC
AAAGACGATTCTATTGACAATAAGGTACTGACGCGCTCTGATAAAAACCGTGGTAAGTCGGACAACGTGCCCTCCGA
AGAGGTTGTGAAAAAGATGAAAAATTATTGGCGCCAGCTTTTAAACGCGAAGCTGATCACACAACGTAAATTCGATA
ATTTGACCAAGGCTGAACGGGGTGGCCTGAGCGAGTTAGATAAGGCAGGATTTATTAAACGCCAGTTAGTGGAGACT
CGTCAAATCACCAAACATGTCGCGCAGATTTTGGACAGCCGGATGAACACCAAGTACGATGAAAATGACAAACTGAT
CCGTGAGGTGAAAGTCATTACTCTGAAGTCCAAATTAGTTAGTGATTTCCGGAAGGACTTTCAATTCTACAAAGTCC
GTGAAATTAATAACTATCATCACGCACATGACGCGTACCTGAATGCAGTGGTTGGGACCGCCCTTATCAAGAAATAT
CCTAAGCTGGAGTCGGAGTTTGTCTATGGCGACTATAAGGTATACGATGTTCGCAAAATGATTGCGAAATCTGAGCA
GGAGATCGGTAAGGCAACCGCAAAATATTTCTTTTACTCAAACATTATGAATTTCTTTAAGACAGAAATCACTCTGG
CCAACGGGGAGATTCGCAAACGTCCGTTGATCGAAACAAACGGCGAGACTGGCGAAATTGTTTGGGACAAAGGGCGT
GATTTCGCGACGGTGCGCAAGGTACTGAGCATGCCTCAAGTCAATATTGTTAAGAAAACCGAAGTGCAGACGGGCGG
GTTTTCCAAGGAAAGCATCTTACCCAAACGTAATTCAGATAAACTTATTGCACGCAAAAAGGACTGGGATCCGAAAA
AGTATGGAGGCTTCGACAGTCCAACCGTAGCCTACTCTGTTCTCGTTGTAGCGAAAGTAGAAAAGGGTAAATCCAAG
AAACTGAAATCTGTCAAGGAGTTGCTTGGAATCACCATTATGGAGCGTAGCTCCTTCGAGAAGAACCCGATTGACTT
TCTGGAAGCCAAAGGATATAAAGAGGTCAAGAAAGATCTTATCATTAAGCTGCCTAAGTATTCACTCTTCGAGCTGG
AAAATGGTCGTAAACGCATGCTCGCTTCTGCCGGCGAGTTGCAGAAGGGCAATGAATTAGCACTTCCATCAAAGTAC
GTTAACTTCCTGTATTTGGCCAGCCATTACGAGAAACTGAAGGGGTCTCCAGAGGACAACGAACAGAAACAATTATT
TGTAGAGCAGCACAAGCATTATCTTGATGAAATCATTGAGCAAATTTCCGAATTCAGTAAACGCGTAATCCTGGCCG
ATGCAAACCTCGACAAGGTGCTGAGCGCTTACAATAAGCATCGCGACAAACCTATCCGTGAGCAGGCTGAAAATATC
ATTCACCTGTTCACATTAACGAACCTGGGCGCTCCGGCCGCTTTTAAATATTTCGACACGACAATCGACCGTAAGCG
CTATACCAGTACGAAAGAAGTGTTGGATGCGACCCTTATTCACCAGTCAATTACAGGATTATATGAGACCCGTATCG
ACCTTAGCCAATTAGGTGGGGATGGAGGCGGAGGATCAGGCGGTGGCGGAAGTGGTGGAGGTGGGTCGGAGGTGGT
GGTAGCATGGTTAGCAAAGGTGAAGAACTGTTTACCGGCGTTGTGCCGATTCTGGTGGAACTGGATGGTGATGTGAA
TGGCCATAAATTTAGCGTTagcGGCGAAGGCGAAGGTGATGCGACCtatGGTAAACTGACCCTGAAATTTATTTGCA
CCACCGGTAAACTGCCGGTTCCGTGGCCGACCCTGGTGACCACCCTGACCTATGGCGTTCAGTGCTTTAGCCGCTAT
CCGGATCATATGAAAcagCATGATTTCTTTAAAAGCGCGATGCCGGAAGGCTATGTGCAGGAACGTACCATTtttTT
CAAAGATGATGGCaacTATAAAACCCGTGCGGAAGTTAAATTTGAAGGCGATACCCTGGTGAACCGCATTGAACTGA
AAGGTATTGATTTTAAAGAAGATGGCAACATTCTGGGTCATAAACTGGAATATAATtacAACAGCCATAATGTGTAT
ATTatgGCCGATAAACAGAAAAATGGCATCAAAgtgAACTTTAAAATCCGTCACAACattGAAGATGGTAGCGTGCA
```

-continued

GCTGGCGGATCATTATCAGCAGAATACCCCGATTGGTGATGGCCCGGTGCTGCTGCCGGATAATCATTATCTGAGCA

CCCAGAGCgcgCTGAGCAAAGATCCGAATGAAAAACGTGATCATATGGTGCTGCTGGAATTTGTTACCGCCGCGGGC

ATTACCctgGGTATGGATGAACTGTATAAA (Cas9-GGGGSEAAAKGGGGS-eGFP chimera DNA sequence)

SEQ ID NO: 350

ATGGACAAAAAGTACTCTATTGGCCTGGATATCGGGACCAACAGCGTCGGGTGGGCTGTTATCACCGACGAGTATAA

AGTACCTTCGAAAAAGTTCAAAGTGCTGGGCAACACCGATCGCCATTCAATCAAAAAGAACTTGATTGGTGCGCTGT

TGTTTGACTCCGGGGAAACCGCCGAGGCGACTCGCCTTAAACGTACAGCACGTCGCCGGTACACTCGGCGTAAGAAT

CGCATTTGCTATTTGCAGGAAATCTTTAGCAACGAGATGGCAAAAGTCGATGACTCGTTTTTCCACCGCCTCGAGGA

AAGCTTTCTGGTGGAGGAAGACAAAAAGCATGAGCGTCACCCGATCTTCGGCAACATTGTCGATGAAGTAGCGTATC

ATGAAAAATACCCAACCATTTACCACTTACGCAAAAAGCTGGTGGACAGCACTGACAAAGCTGATTTGCGCCTTATC

TATTTAGCCCTGGCACATATGATTAAGTTTCGTGGTCACTTCCTGATCGAAGGAGACTTAAATCCCGACAACAGTGA

TGTTGATAAATTGTTTATTCAGCTTGTCCAAACTTACAATCAACTGTTCGAGGAAAACCCGATCAATGCCTCCGGTG

TGGATGCAAAAGCCATTTTAAGTGCACGCCTTAGCAAGTCCCGTCGCTTAGAAAACCTTATCGCGCAGCTGCCCGGC

GAGAAAAAGAATGGTTTGTTTGGGAACCTTATTGCCTTGAGCTTAGGCCTCACCCCGAATTTCAAAAGTAATTTCGA

TCTTGCAGAAGACGCCAAATTACAACTGTCGAAGGATACTTATGATGACGATCTCGATAATCTGTTAGCGCAGATTG

GTGACCAATACGCCGATCTTTTTCTGGCGGCTAAAAATCTGAGCGACGCCATCTTGCTTTCGGATATTCTCCGCGTT

AACACCGAAATCACGAAAGCGCCTCTTAGTGCCAGCATGATTAAACGTTATGATGAACACCACCAGGACCTGACCTT

ACTCAAAGCGTTGGTTCGCCAGCAACTGCCAGAGAAGTACAAAGAAATCTTCTTTGATCAGTCAAAGAATGGTTATG

CCGGCTATATTGACGGGGGTGCAAGCCAAGAGGAATTCTACAAATTTATCAAGCCTATTCTGGAGAAAATGGATGGC

ACCGAAGAGTTATTGGTGAAGCTTAACCGTGAAGACCTCCTGCGGAAACAGCGCACATTCGATAATGGTTCGATCCC

ACACCAAATCCATTTGGGGGAGTTACACGCTATTTTGCGTCGCCAGGAAGACTTTTACCCTTTCCTGAAGGATAACC

GGGAGAAAATTGAGAAGATCCTTACCTTTCGTATTCCGTATTACGTAGGCCCCTTAGCACGGGGTAATAGCCGTTTC

GCGTGGATGACACGGAAGTCGGAAGAGACGATCACCCCGTGGAACTTCGAAGAGGTAGTCGACAAGGGCGCATCAGC

GCAGTCTTTTATTGAACGTATGACGAATTTCGATAAAAACTTGCCCAATGAGAAGGTGCTTCCGAAACATTCCTTGT

TATATGAATATTTTACAGTTTACAACGAGCTGACCAAGGTTAAATACGTGACGGAAGGAATGCGCAAGCCCGCTTTT

CTTAGCGGTGAGCAAAAAAAGGCGATCGTCGACCTGTTATTCAAAACGAATCGTAAGGTGACTGTAAAGCAACTCAA

AGAAGATTACTTCAAAAAGATTGAGTGCTTCGACAGCGTCGAAATCTCTGGGGTAGAGGATCGGTTTAACGCAAGTT

TAGGTACCTACCATGACCTGCTTAAAATCATTAAGGATAAAGACTTCTTAGATAATGAAGAGAACGAAGATATTCTC

GAGGACATCGTCTTGACGTTAACCTTATTTGAGGATCGTGAAATGATTGAGGAACGCCTCAAAACTTATGCCCACCT

GTTCGACGATAAGGTGATGAAGCAGCTGAAACGTCGGCGCTACACAGGATGGGGCCGCTTGAGTCGCAAACTTATTA

ACGGAATCCGTGACAAGCAATCCGGCAAAACGATTCTGGATTTCTTGAAGTCGGACGGATTTGCTAATCGCAACTTC

ATGCAGTTGATCCATGATGACTCCCTGACTTTTAAAGAGGATATTCAAAAGGCGCAGGTTAGTGGTCAAGGCGACAG

CTTACACGAACACATCGCAAATTTGGCTGGTTCGCCGGCCATTAAAAAGGGGATCCTCCAGACCGTGAAAGTTGTAG

ATGAGCTTGTTAAGGTCATGGGTCGTCATAAGCCCGAAAACATCGTGATTGAAATGGCGCGGGAGAATCAAACGACC

CAGAAAGGACAAAAGAATAGCCGTGAACGGATGAAGCGGATCGAGGAAGGCATTAAAGAGCTGGGGTCTCAAATCTT

GAAGGAACACCCTGTGGAGAACACTCAGCTCCAAAATGAAAAACTTTACCTGTACTATTTGCAGAACGGACGCGATA

TGTACGTGGACCAAGAGTTGGATATTAATCGGCTGAGTGACTACGACGTTGATCATATCGTCCCGCAGAGCTTCCTC

AAAGACGATTCTATTGACAATAAGGTACTGACGCGCTCTGATAAAAACCGTGGTAAGTCGGACAACGTGCCCTCCGA

AGAGGTTGTGAAAAAGATGAAAAATTATTGGCGCCAGCTTTTAAACGCGAAGCTGATCACACAACGTAAATTCGATA

ATTTGACCAAGGCTGAACGGGGTGGCCTGAGCGAGTTAGATAAGGCAGGATTTATTAAACGCCAGTTAGTGGAGACT

-continued

```
CGTCAAATCACCAAACATGTCGCGCAGATTTTGGACAGCCGGATGAACACCAAGTACGATGAAAATGACAAACTGAT
CCGTGAGGTGAAAGTCATTACTCTGAAGTCCAAATTAGTTAGTGATTTCCGGAAGGACTTTCAATTCTACAAAGTCC
GTGAAATTAATAACTATCATCACGCACATGACGCGTACCTGAATGCAGTGGTTGGGACCGCCCTTATCAAGAAATAT
CCTAAGCTGGAGTCGGAGTTTGTCTATGGCGACTATAAGGTATACGATGTTCGCAAAATGATTGCGAAATCTGAGCA
GGAGATCGGTAAGGCAACCGCAAAATATTTCTTTTACTCAAACATTATGAATTTCTTTAAGACAGAAATCACTCTGG
CCAACGGGAGATTCGCAAACGTCCGTTGATCGAAACAAACGGCGAGACTGGCGAAATTGTTTGGGACAAAGGGCGT
GATTTCGCGACGGTGCGCAAGGTACTGAGCATGCCTCAAGTCAATATTGTTAAGAAAACCGAAGTGCAGACGGGCGG
GTTTTCCAAGGAAAGCATCTTACCCAAACGTAATTCAGATAAACTTATTGCACGCAAAAAGGACTGGGATCCGAAAA
AGTATGGAGGCTTCGACAGTCCAACCGTAGCCTACTCTGTTCTCGTTGTAGCGAAAGTAGAAAAGGGTAAATCCAAG
AAACTGAAATCTGTCAAGGAGTTGCTTGGAATCACCATTATGGAGCGTAGCTCCTTCGAGAAGAACCCGATTGACTT
TCTGGAAGCCAAAGGATATAAAGAGGTCAAGAAAGATCTTATCATTAAGCTGCCTAAGTATTCACTCTTCGAGCTGG
AAAATGGTCGTAAACGCATGCTCGCTTCTGCCGGCGAGTTGCAGAAGGGCAATGAATTAGCACTTCCATCAAAGTAC
GTTAACTTCCTGTATTTGGCCAGCCATTACGAGAAACTGAAGGGGTCTCCAGAGGACAACGAACAGAAACAATTATT
TGTAGAGCAGCACAAGCATTATCTTGATGAAATCATTGAGCAAATTTCCGAATTCAGTAAACGCGTAATCCTGGCCG
ATGCAAACCTCGACAAGGTGCTGAGCGCTTACAATAAGCATCGCGACAAACCTATCCGTGAGCAGGCTGAAAATATC
ATTCACCTGTTCACATTAACGAACCTGGGCGCTCCGGCCGCTTTTAAATATTTCGACACGACAATCGACCGTAAGCG
CTATACCAGTACGAAAGAAGTGTTGGATGCGACCCTTATTCACCAGTCAATTACAGGATTATATGAGACCCGTATCG
ACCTTAGCCAATTAGGTGGGGATGGAGGCGGAGGGTCGGAAGCGGCAGCAAAAGGAGGCGGAGGAAGTATGGTTAGC
AAAGGTGAAGAACTGTTTACCGGCGTTGTGCCGATTCTGGTGGAACTGGATGGTGATGTGAATGGCCATAAATTTAG
CGTTagcGGCGAAGGCGAAGGTGATGCGACCtatGGTAAACTGACCCTGAAATTTATTTGCACCACCGGTAAACTGC
CGGTTCCGTGGCCGACCCTGGTGACCACCCTGACCTATGGCGTTCAGTGCTTTAGCCGCTATCCGGATCATATGAAA
cagCATGATTTCTTTAAAAGCGCGATGCCGGAAGGCTATGTGCAGGAACGTACCATTtttTTCAAAGATGATGGCaa
cTATAAAACCCGTGCGGAAGTTAAATTTGAAGGCGATACCCTGGTGAACCGCATTGAACTGAAAGGTATTGATTTTA
AAGAAGATGGCAACATTCTGGGTCATAAACTGGAATATAATtacAACAGCCATAATGTGTATATTatgGCCGATAAA
CAGAAAAATGGCATCAAAgtgAACTTTAAAATCCGTCACAACattGAAGATGGTAGCGTGCAGCTGGCGGATCATTA
TCAGCAGAATACCCCGATTGGTGATGGCCCGGTGCTGCTGCCGGATAATCATTATCTGAGCACCCAGAGCgcgCTGA
GCAAAGATCCGAATGAAAACGTGATCATATGGTGCTGCTGGAATTTGTTACCGCCGCGGGCATTACCctgGGTATG
GATGAACTGTATAAA
```

(Cas9-A(EAAAK)4A-eGFP chimera DNA sequence)

SEQ ID NO: 351

```
ATGGACAAAAAGTACTCTATTGGCCTGGATATCGGGACCAACAGCGTCGGGTGGCTGTTATCACCGACGAGTATAA
AGTACCTTCGAAAAAGTTCAAAGTGCTGGGCAACACCGATCGCCATTCAATCAAAAAGAACTTGATTGGTGCGCTGT
TGTTTGACTCCGGGGAAACCGCCGAGGCGACTCGCCTTAAACGTACAGCACGTCGCCGGTACACTCGGCGTAAGAAT
CGCATTTGCTATTTGCAGGAAATCTTTAGCAACGAGATGGCAAAAGTCGATGACTCGTTTTTCCACCGCCTCGAGGA
AAGCTTTCTGGTGGAGGAAGACAAAAAGCATGAGCGTCACCCGATCTTCGGCAACATTGTCGATGAAGTAGCGTATC
ATGAAAAATACCCAACCATTTACCACTTACGCAAAAAGCTGGTGGACAGCACTGACAAAGCTGATTTGCGCCTTATC
TATTTAGCCCTGGCACATATGATTAAGTTTCGTGGTCACTTCCTGATCGAAGGAGACTTAAATCCCGACAACAGTGA
TGTTGATAAATTGTTTATTCAGCTTGTCCAAACTTACAATCAACTGTTCGAGGAAAACCCGATCAATGCCTCCGGTG
TGGATGCAAAAGCCATTTTAAGTGCACGCCTTAGCAAGTCCCGTCGCTTAGAAAACCTTATCGCGCAGCTGCCCGGC
GAGAAAAAGAATGGTTTGTTTGGGAACCTTATTGCCTTGAGCTTAGGCCTCACCCCGAATTTCAAAAGTAATTTCGA
TCTTGCAGAAGACGCCAAATTACAACTGTCGAAGGATACTTATGATGACGATCTCGATAATCTGTTAGCGCAGATTG
GTGACCAATACGCCGATCTTTTTCTGGCGGCTAAAAATCTGAGCGACGCCATCTTGCTTTCGGATATTCTCCGCGTT
```

-continued

```
AACACCGAAATCACGAAAGCGCCTCTTAGTGCCAGCATGATTAAACGTTATGATGAACACCACCAGGACCTGACCTT
ACTCAAAGCGTTGGTTCGCCAGCAACTGCCAGAGAAGTACAAAGAAATCTTCTTTGATCAGTCAAAGAATGGTTATG
CCGGCTATATTGACGGGGGTGCAAGCCAAGAGGAATTCTACAAATTTATCAAGCCTATTCTGGAGAAAATGGATGGC
ACCGAAGAGTTATTGGTGAAGCTTAACCGTGAAGACCTCCTGCGGAAACAGCGCACATTCGATAATGGTTCGATCCC
ACACCAAATCCATTTGGGGGAGTTACACGCTATTTTGCGTCGCCAGGAAGACTTTTACCCTTTCCTGAAGGATAACC
GGGAGAAAATTGAGAAGATCCTTACCTTTCGTATTCCGTATTACGTAGGCCCCTTAGCACGGGGTAATAGCCGTTTC
GCGTGGATGACACGGAAGTCGGAAGAGACGATCACCCCGTGGAACTTCGAAGAGGTAGTCGACAAGGGCGCATCAGC
GCAGTCTTTTATTGAACGTATGACGAATTTCGATAAAAACTTGCCCAATGAGAAGGTGCTTCCGAAACATTCCTTGT
TATATGAATATTTTACAGTTTACAACGAGCTGACCAAGGTTAAATACGTGACGGAAGGAATGCGCAAGCCCGCTTTT
CTTAGCGGTGAGCAAAAAAGGCGATCGTCGACCTGTTATTCAAAACGAATCGTAAGGTGACTGTAAAGCAACTCAA
AGAAGATTACTTCAAAAAGATTGAGTGCTTCGACAGCGTCGAAATCTCTGGGGTAGAGGATCGGTTTAACGCAAGTT
TAGGTACCTACCATGACCTGCTTAAAATCATTAAGGATAAAGACTTCTTAGATAATGAAGAGAACGAAGATATTCTC
GAGGACATCGTCTTGACGTTAACCTTATTTGAGGATCGTGAAATGATTGAGGAACGCCTCAAAACTTATGCCCACCT
GTTCGACGATAAGGTGATGAAGCAGCTGAAACGTCGGCGCTACACAGGATGGGGCCGCTTGAGTCGCAAACTTATTA
ACGGAATCCGTGACAAGCAATCCGGCAAAACGATTCTGGATTTCTTGAAGTCGGACGGATTTGCTAATCGCAACTTC
ATGCAGTTGATCCATGATGACTCCCTGACTTTTAAAGAGGATATTCAAAAGGCGCAGGTTAGTGGTCAAGGCGACAG
CTTACACGAACACATCGCAAATTTGGCTGGTTCGCCGGCCATTAAAAAGGGGATCCTCCAGACCGTGAAAGTTGTAG
ATGAGCTTGTTAAGGTCATGGGTCGTCATAAGCCCGAAAACATCGTGATTGAAATGGCGCGGGAGAATCAAACGACC
CAGAAAGGACAAAAGAATAGCCGTGAACGGATGAAGCGGATCGAGGAAGGCATTAAAGAGCTGGGGTCTCAAATCTT
GAAGGAACACCCTGTGGAGAACACTCAGCTCCAAAATGAAAAACTTTACCTGTACTATTTGCAGAACGGACGCGATA
TGTACGTGGACCAAGAGTTGGATATTAATCGGCTGAGTGACTACGACGTTGATCATATCGTCCCGCAGAGCTTCCTC
AAAGACGATTCTATTGACAATAAGGTACTGACGCGCTCTGATAAAAACCGTGGTAAGTCGGACAACGTGCCCTCCGA
AGAGGTTGTGAAAAAGATGAAAAATTATTGGCGCCAGCTTTTAAACGCGAAGCTGATCACACAACGTAAATTCGATA
ATTTGACCAAGGCTGAACGGGGTGGCCTGAGCGAGTTAGATAAGGCAGGATTTATTAAACGCCAGTTAGTGGAGACT
CGTCAAATCACCAAACATGTCGCGCAGATTTTGGACAGCCGGATGAACACCAAGTACGATGAAAATGACAAACTGAT
CCGTGAGGTGAAAGTCATTACTCTGAAGTCCAAATTAGTTAGTGATTTCCGGAAGGACTTTCAATTCTACAAAGTCC
GTGAAATTAATAACTATCATCACGCACATGACGCGTACCTGAATGCAGTGGTTGGGACCGCCCTTATCAAGAAATAT
CCTAAGCTGGAGTCGGAGTTTGTCTATGGCGACTATAAGGTATACGATGTTCGCAAAATGATTGCGAAATCTGAGCA
GGAGATCGGTAAGGCAACCGCAAAATATTTCTTTTACTCAAACATTATGAATTTCTTTAAGACAGAAATCACTCTGG
CCAACGGGGAGATTCGCAAACGTCCGTTGATCGAAACAAACGGCGAGACTGGCGAAATTGTTTGGGACAAAGGGCGT
GATTTCGCGACGGTGCGCAAGGTACTGAGCATGCCTCAAGTCAATATTGTTAAGAAAACCGAAGTGCAGACGGGCGG
GTTTTCCAAGGAAAGCATCTTACCCAAACGTAATTCAGATAAACTTATTGCACGCAAAAAGGACTGGGATCCGAAAA
AGTATGGAGGCTTCGACAGTCCAACCGTAGCCTACTCTGTTCTCGTTGTAGCGAAAGTAGAAAAGGGTAAATCCAAG
AAACTGAAATCTGTCAAGGAGTTGCTTGGAATCACCATTATGGAGCGTAGCTCCTTCGAGAAGAACCCGATTGACTT
TCTGGAAGCCAAAGGATATAAAGAGGTCAAGAAAGATCTTATCATTAAGCTGCCTAAGTATTCACTCTTCGAGCTGG
AAAATGGTCGTAAACGCATGCTCGCTTCTGCCGGCGAGTTGCAGAAGGGCAATGAATTAGCACTTCCATCAAAGTAC
GTTAACTTCCTGTATTTGGCCAGCCATTACGAGAAACTGAAGGGGTCTCCAGAGGACAACGAACAGAAACAATTATT
TGTAGAGCAGCACAAGCATTATCTTGATGAAATCATTGAGCAAATTTCCGAATTCAGTAAACGCGTAATCCTGGCCG
ATGCAAACCTCGACAAGGTGCTGAGCGCTTACAATAAGCATCGCGACAAACCTATCCGTGAGCAGGCTGAAAATATC
ATTCACCTGTTCACATTAACGAACCTGGGCGCTCCGGCCGCTTTTAAATATTTCGACACGACAATCGACCGTAAGCG
```

-continued

CTATACCAGTACGAAAGAAGTGTTGGATGCGACCCTTATTCACCAGTCAATTACAGGATTATATGAGACCCGTATCG

ACCTTAGCCAATTAGGTGGGGATGCTGAGGCCGCAGCAAAAGAGGCTGCCGCTAAGGAGGCTGCTGCAAAAGAAGCA

GCAGCGAAAGCTATGGTTAGCAAAGGTGAAGAACTGTTTACCGGCGTTGTGCCGATTCTGGTGGAACTGGATGGTGA

TGTGAATGGCCATAAATTTAGCGTTagcGGCGAAGGCGAAGGTGATGCGACCtatGGTAAACTGACCCTGAAATTTA

TTTGCACCACCGGTAAACTGCCGGTTCCGTGGCCGACCCTGGTGACCACCCTGACCTATGGCGTTCAGTGCTTTAGC

CGCTATCCGGATCATATGAAAcagCATGATTTCTTTAAAAGCGCGATGCCGGAAGGCTATGTGCAGGAACGTACCAT

TtttTTCAAAGATGATGGCaacTATAAAACCCGTGCGGAAGTTAAATTTGAAGGCGATACCCTGGTGAACCGCATTG

AACTGAAAGGTATTGATTTTAAAGAAGATGGCAACATTCTGGGTCATAAACTGGAATATAATtacAACAGCCATAAT

GTGTATATTatgGCCGATAAACAGAAAAATGGCATCAAAgtgAACTTTAAAATCCGTCACAACattGAAGATGGTAG

CGTGCAGCTGGCGGATCATTATCAGCAGAATACCCCGATTGGTGATGGCCCGGTGCTGCTGCCGGATAATCATTATC

TGAGCACCCAGAGCgcgCTGAGCAAAGATCCGAATGAAAAACGTGATCATATGGTGCTGCTGGAATTTGTTACCGCC

GCGGGCATTACCctgGGTATGGATGAACTGTATAAA (Cas9-A(EAAAK)₄ALEA(EAAAK)₄A-eGFP chimera DNA sequence)

SEQ ID NO: 352

ATGGACAAAAAGTACTCTATTGGCCTGGATATCGGGACCAACAGCGTCGGGTGGGCTGTTATCACCGACGAGTATAA

AGTACCTTCGAAAAAGTTCAAAGTGCTGGGCAACACCGATCGCCATTCAATCAAAAAGAACTTGATTGGTGCGCTGT

TGTTTGACTCCGGGGAAACCGCCGAGGCGACTCGCCTTAAACGTACAGCACGTCGCCGGTACACTCGGCGTAAGAAT

CGCATTTGCTATTTGCAGGAAATCTTTAGCAACGAGATGGCAAAAGTCGATGACTCGTTTTTCCACCGCCTCGAGGA

AAGCTTTCTGGTGGAGGAAGACAAAAAGCATGAGCGTCACCCGATCTTCGGCAACATTGTCGATGAAGTAGCGTATC

ATGAAAAATACCCAACCATTTACCACTTACGCAAAAAGCTGGTGGACAGCACTGACAAAGCTGATTTGCGCCTTATC

TATTTAGCCCTGGCACATATGATTAAGTTTCGTGGTCACTTCCTGATCGAAGGAGACTTAAATCCCGACAACAGTGA

TGTTGATAAATTGTTTATTCAGCTTGTCCAAACTTACAATCAACTGTTCGAGGAAAACCCGATCAATGCCTCCGGTG

TGGATGCAAAAGCCATTTTAAGTGCACGCCTTAGCAAGTCCCGTCGCTTAGAAAACCTTATCGCGCAGCTGCCCGGC

GAGAAAAGAATGGTTTGTTTGGGAACCTTATTGCCTTGAGCTTAGGCCTCACCCCGAATTTCAAAAGTAATTTCGA

TCTTGCAGAAGACGCCAAATTACAACTGTCGAAGGATACTTATGATGACGATCTCGATAATCTGTTAGCGCAGATTG

GTGACCAATACGCCGATCTTTTTCTGGCGGCTAAAAATCTGAGCGACGCCATCTTGCTTTCGGATATTCTCCGCGTT

AACACCGAAATCACGAAAGCGCCTCTTAGTGCCAGCATGATTAAACGTTATGATGAACACCACCAGGACCTGACCTT

ACTCAAAGCGTTGGTTCGCCAGCAACTGCCAGAGAAGTACAAAGAAATCTTCTTTGATCAGTCAAAGAATGGTTATG

CCGGCTATATTGACGGGGGTGCAAGCCAAGAGGAATTCTACAAATTTATCAAGCCTATTCTGGAGAAAATGGATGGC

ACCGAAGAGTTATTGGTGAAGCTTAACCGTGAAGACCTCCTGCGGAAACAGCGCACATTCGATAATGGTTCGATCCC

ACACCAAATCCATTTGGGGGAGTTACACGCTATTTTGCGTCGCCAGGAAGACTTTTACCCTTTCCTGAAGGATAACC

GGGAGAAAATTGAGAAGATCCTTACCTTTCGTATTCCGTATTACGTAGGCCCCTTAGCACGGGGTAATAGCCGTTTC

GCGTGGATGACACGGAAGTCGGAAGAGACGATCACCCCGTGGAACTTCGAAGAGGTAGTCGACAAGGGCGCATCAGC

GCAGTCTTTTATTGAACGTATGACGAATTTCGATAAAAACTTGCCCAATGAGAAGGTGCTTCCGAAACATTCCTTGT

TATATGAATATTTTACAGTTTACAACGAGCTGACCAAGGTTAAATACGTGACGGAAGGAATGCGCAAGCCCGCTTTT

CTTAGCGGTGAGCAAAAAAGGCGATCGTCGACCTGTTATTCAAAACGAATCGTAAGGTGACTGTAAAGCAACTCAA

AGAAGATTACTTCAAAAAGATTGAGTGCTTCGACAGCGTCGAAATCTCTGGGGTAGAGGATCGGTTTAACGCAAGTT

TAGGTACCTACCATGACCTGCTTAAAATCATTAAGGATAAAGACTTCTTAGATAATGAAGAGAACGAAGATATTCTC

GAGGACATCGTCTTGACGTTAACCTTATTTGAGGATCGTGAAATGATTGAGGAACGCCTCAAAACTTATGCCCACCT

GTTCGACGATAAGGTGATGAAGCAGCTGAAACGTCGGCGCTACACAGGATGGGGCCGCTTGAGTCGCAAACTTATTA

ACGGAATCCGTGACAAGCAATCCGGCAAAACGATTCTGGATTTCTTGAAGTCGGACGGATTTGCTAATCGCAACTTC

ATGCAGTTGATCCATGATGACTCCCTGACTTTTAAAGAGGATATTCAAAAGGCGCAGGTTAGTGGTCAAGGCGACAG

```
CTTACACGAACACATCGCAAATTTGGCTGGTTCGCCGGCCATTAAAAAGGGGATCCTCCAGACCGTGAAAGTTGTAG
ATGAGCTTGTTAAGGTCATGGGTCGTCATAAGCCCGAAAACATCGTGATTGAAATGGCGCGGGAGAATCAAACGACC
CAGAAAGGACAAAAGAATAGCCGTGAACGGATGAAGCGGATCGAGGAAGGCATTAAAGAGCTGGGGTCTCAAATCTT
GAAGGAACACCCTGTGGAGAACACTCAGCTCCAAAATGAAAAACTTTACCTGTACTATTTGCAGAACGGACGCGATA
TGTACGTGGACCAAGAGTTGGATATTAATCGGCTGAGTGACTACGACGTTGATCATATCGTCCCGCAGAGCTTCCTC
AAAGACGATTCTATTGACAATAAGGTACTGACGCGCTCTGATAAAACCGTGGTAAGTCGGACAACGTGCCCTCCGA
AGAGGTTGTGAAAAAGATGAAAAATTATTGGCGCCAGCTTTTAAACGCGAAGCTGATCACACAACGTAAATTCGATA
ATTTGACCAAGGCTGAACGGGGTGGCCTGAGCGAGTTAGATAAGGCAGGATTTATTAAACGCCAGTTAGTGGAGACT
CGTCAAATCACCAAACATGTCGCGCAGATTTTGGACAGCCGGATGAACACCAAGTACGATGAAAATGACAAACTGAT
CCGTGAGGTGAAAGTCATTACTCTGAAGTCCAAATTAGTTAGTGATTTCCGGAAGGACTTTCAATTCTACAAAGTCC
GTGAAATTAATAACTATCATCACGCACATGACGCGTACCTGAATGCAGTGGTTGGGACCGCCCTTATCAAGAAATAT
CCTAAGCTGGAGTCGGAGTTTGTCTATGGCGACTATAAGGTATACGATGTTCGCAAAATGATTGCGAAATCTGAGCA
GGAGATCGGTAAGGCAACCGCAAAATATTTCTTTTACTCAAACATTATGAATTTCTTTAAGACAGAAATCACTCTGG
CCAACGGGGAGATTCGCAAACGTCCGTTGATCGAAACAAACGGCGAGACTGGCGAAATTGTTTGGGACAAAGGGCGT
GATTTCGCGACGGTGCGCAAGGTACTGAGCATGCCTCAAGTCAATATTGTTAAGAAAACCGAAGTGCAGACGGGCGG
GTTTTCCAAGGAAAGCATCTTACCCAAACGTAATTCAGATAAACTTATTGCACGCAAAAAGGACTGGGATCCGAAAA
AGTATGGAGGCTTCGACAGTCCAACCGTAGCCTACTCTGTTCTCGTTGTAGCGAAAGTAGAAAAGGGTAAATCCAAG
AAACTGAAATCTGTCAAGGAGTTGCTTGGAATCACCATTATGGAGCGTAGCTCCTTCGAGAAGAACCCGATTGACTT
TCTGGAAGCCAAAGGATATAAAGAGGTCAAGAAAGATCTTATCATTAAGCTGCCTAAGTATTCACTCTTCGAGCTGG
AAAATGGTCGTAAACGCATGCTCGCTTCTGCCGGCGAGTTGCAGAAGGGCAATGAATTAGCACTTCCATCAAAGTAC
GTTAACTTCCTGTATTTGGCCAGCCATTACGAGAAACTGAAGGGGTCTCCAGAGGACAACGAACAGAAACAATTATT
TGTAGAGCAGCACAAGCATTATCTTGATGAAATCATTGAGCAAATTTCCGAATTCAGTAAACGCGTAATCCTGGCCG
ATGCAAACCTCGACAAGGTGCTGAGCGCTTACAATAAGCATCGCGACAAACCTATCCGTGAGCAGGCTGAAAATATC
ATTCACCTGTTCACATTAACGAACCTGGGCGCTCCGGCCGCTTTTAAATATTTCGACACGACAATCGACCGTAAGCG
CTATACCAGTACGAAAGAAGTGTTGGATGCGACCCTTATTCACCAGTCAATTACAGGATTATATGAGACCCGTATCG
ACCTTAGCCAATTAGGTGGGGATGCCGAAGCAGCAGCCAAAGAAGCTGCCGCAAAGGAGGCGGCAGCTAAAGAAGCG
GCCGCTAAGGCATTGGAAGCGGAGGCGGCTGCCAAGGAGGCTGCGGCGAAAGAAGCTGCGGCCAAAGAAGCGGCTGC
AAAAGCGATGGTTAGCAAAGGTGAAGAACTGTTTACCGGCGTTGTGCCGATTCTGGTGGAACTGGATGGTGATGTGA
ATGGCCATAAATTTAGCGTTagcGGCGAAGGCGAAGGTGATGCGACCtatGGTAAACTGACCCTGAAATTTATTTGC
ACCACCGGTAAACTGCCGGTTCCGTGGCCGACCCTGGTGACCACCCTGACCTATGGCGTTCAGTGCTTTAGCCGCTA
TCCGGATCATATGAAAcagCATGATTTCTTTAAAAGCGCGATGCCGGAAGGCTATGTGCAGGAACGTACCATTtttT
TCAAAGATGATGGCaacTATAAAACCCGTGCGGAAGTTAAATTTGAAGGCGATACCCTGGTGAACCGCATTGAACTG
AAAGGTATTGATTTTAAAGAAGATGGCAACATTCTGGGTCATAAACTGGAATATAATtacAACAGCCATAATGTGTA
TATTatgGCCGATAAACAGAAAAATGGCATCAAAgtgAACTTTAAAATCCGTCACAACattGAAGATGGTAGCGTGC
AGCTGGCGGATCATTATCAGCAGAATACCCCGATTGGTGATGGCCCGGTGCTGCTGCCGGATAATCATTATCTGAGC
ACCCAGAGCGcgCTGAGCAAAGATCCGAATGAAAAACGTGATCATATGGTGCTGCTGGAATTTGTTACCGCCGCGGG
CATTACCctgGGTATGGATGAACTGTATAAA
```

(Cas9-LEA(EAAAK)₄ALEA(EAAAK)₄ALE-eGFP chimera DNA sequence)
SEQ ID NO: 353
```
ATGGACAAAAAGTACTCTATTGGCCTGGATATCGGGACCAACAGCGTCGGGTGGGCTGTTATCACCGACGAGTATAA
AGTACCTTCGAAAAAGTTCAAAGTGCTGGGCAACACCGATCGCCATTCAATCAAAAAGAACTTGATTGGTGCGCTGT
```

-continued
TGTTTGACTCCGGGGAAACCGCCGAGGCGACTCGCCTTAAACGTACAGCACGTCGCCGGTACACTCGGCGTAAGAAT

CGCATTTGCTATTTGCAGGAAATCTTTAGCAACGAGATGGCAAAAGTCGATGACTCGTTTTTCCACCGCCTCGAGGA

AAGCTTTCTGGTGGAGGAAGACAAAAAGCATGAGCGTCACCCGATCTTCGGCAACATTGTCGATGAAGTAGCGTATC

ATGAAAAATACCCAACCATTTACCACTTACGCAAAAAGCTGGTGGACAGCACTGACAAAGCTGATTTGCGCCTTATC

TATTTAGCCCTGGCACATATGATTAAGTTTCGTGGTCACTTCCTGATCGAAGGAGACTTAAATCCCGACAACAGTGA

TGTTGATAAATTGTTTATTCAGCTTGTCCAAACTTACAATCAACTGTTCGAGGAAAACCCGATCAATGCCTCCGGTG

TGGATGCAAAAGCCATTTTAAGTGCACGCCTTAGCAAGTCCCGTCGCTTAGAAAACCTTATCGCGCAGCTGCCCGGC

GAGAAAAAGAATGGTTTGTTTGGGAACCTTATTGCCTTGAGCTTAGGCCTCACCCCGAATTTCAAAAGTAATTTCGA

TCTTGCAGAAGACGCCAAATTACAACTGTCGAAGGATACTTATGATGACGATCTCGATAATCTGTTAGCGCAGATTG

GTGACCAATACGCCGATCTTTTTCTGGCGGCTAAAAATCTGAGCGACGCCATCTTGCTTTCGGATATTCTCCGCGTT

AACACCGAAATCACGAAAGCGCCTCTTAGTGCCAGCATGATTAAACGTTATGATGAACACCACCAGGACCTGACCTT

ACTCAAAGCGTTGGTTCGCCAGCAACTGCCAGAGAAGTACAAAGAAATCTTCTTTGATCAGTCAAAGAATGGTTATG

CCGGCTATATTGACGGGGGTGCAAGCCAAGAGGAATTCTACAAATTTATCAAGCCTATTCTGGAGAAAATGGATGGC

ACCGAAGAGTTATTGGTGAAGCTTAACCGTGAAGACCTCCTGCGGAAACAGCGCACATTCGATAATGGTTCGATCCC

ACACCAAATCCATTTGGGGGAGTTACACGCTATTTTGCGTCGCCAGGAAGACTTTTACCCTTTCCTGAAGGATAACC

GGGAGAAAATTGAGAAGATCCTTACCTTTCGTATTCCGTATTACGTAGGCCCCTTAGCACGGGGTAATAGCCGTTTC

GCGTGGATGACACGGAAGTCGGAAGAGACGATCACCCCGTGGAACTTCGAAGAGGTAGTCGACAAGGGCGCATCAGC

GCAGTCTTTTATTGAACGTATGACGAATTTCGATAAAAACTTGCCCAATGAGAAGGTGCTTCCGAAACATTCCTTGT

TATATGAATATTTTACAGTTTACAACGAGCTGACCAAGGTTAAATACGTGACGGAAGGAATGCGCAAGCCCGCTTTT

CTTAGCGGTGAGCAAAAAAAGGCGATCGTCGACCTGTTATTCAAAACGAATCGTAAGGTGACTGTAAAGCAACTCAA

AGAAGATTACTTCAAAAAGATTGAGTGCTTCGACAGCGTCGAAATCTCTGGGGTAGAGGATCGGTTTAACGCAAGTT

TAGGTACCTACCATGACCTGCTTAAAATCATTAAGGATAAAGACTTCTTAGATAATGAAGAGAACGAAGATATTCTC

GAGGACATCGTCTTGACGTTAACCTTATTTGAGGATCGTGAAATGATTGAGGAACGCCTCAAAACTTATGCCCACCT

GTTCGACGATAAGGTGATGAAGCAGCTGAAACGTCGGCGCTACACAGGATGGGGCCGCTTGAGTCGCAAACTTATTA

ACGGAATCCGTGACAAGCAATCCGGCAAAACGATTCTGGATTTCTTGAAGTCGGACGGATTTGCTAATCGCAACTTC

ATGCAGTTGATCCATGATGACTCCCTGACTTTTAAAGAGGATATTCAAAAGGCGCAGGTTAGTGGTCAAGGCGACAG

CTTACACGAACACATCGCAAATTTGGCTGGTTCGCCGGCCATTAAAAAGGGGATCCTCCAGACCGTGAAAGTTGTAG

ATGAGCTTGTTAAGGTCATGGGTCGTCATAAGCCCGAAAACATCGTGATTGAAATGGCGCGGGAGAATCAAACGACC

CAGAAAGGACAAAAGAATAGCCGTGAACGGATGAAGCGGATCGAGGAAGGCATTAAAGAGCTGGGGTCTCAAATCTT

GAAGGAACACCCTGTGGAGAACACTCAGCTCCAAAATGAAAAACTTTACCTGTACTATTTGCAGAACGGACGCGATA

TGTACGTGGACCAAGAGTTGGATATTAATCGGCTGAGTGACTACGACGTTGATCATATCGTCCCGCAGAGCTTCCTC

AAAGACGATTCTATTGACAATAAGGTACTGACGCGCTCTGATAAAAACCGTGGTAAGTCGGACAACGTGCCCTCCGA

AGAGGTTGTGAAAAAGATGAAAAATTATTGGCGCCAGCTTTTAAACGCGAAGCTGATCACACAACGTAAATTCGATA

ATTTGACCAAGGCTGAACGGGGTGGCCTGAGCGAGTTAGATAAGGCAGGATTTATTAAACGCCAGTTAGTGGAGACT

CGTCAAATCACCAAACATGTCGCGCAGATTTTGGACAGCCGGATGAACACCAAGTACGATGAAAATGACAAACTGAT

CCGTGAGGTGAAAGTCATTACTCTGAAGTCCAAATTAGTTAGTGATTTCCGGAAGGACTTTCAATTCTACAAAGTCC

GTGAAATTAATAACTATCATCACGCACATGACGCGTACCTGAATGCAGTGGTTGGGACCGCCCTTATCAAGAAATAT

CCTAAGCTGGAGTCGGAGTTTGTCTATGGCGACTATAAGGTATACGATGTTCGCAAAATGATTGCGAAATCTGAGCA

GGAGATCGGTAAGGCAACCGCAAAATATTTCTTTTACTCAAACATTATGAATTTCTTTAAGACAGAAATCACTCTGG

CCAACGGGGAGATTCGCAAACGTCCGTTGATCGAAACAAACGGCGAGACTGGCGAAATTGTTTGGGACAAAGGGCGT

GATTTCGCGACGGTGCGCAAGGTACTGAGCATGCCTCAAGTCAATATTGTTAAGAAAACCGAAGTGCAGACGGGCGG

```
GTTTTCCAAGGAAAGCATCTTACCCAAACGTAATTCAGATAAACTTATTGCACGCAAAAAGGACTGGGATCCGAAAA

AGTATGGAGGCTTCGACAGTCCAACCGTAGCCTACTCTGTTCTCGTTGTAGCGAAAGTAGAAAAGGGTAAATCCAAG

AAACTGAAATCTGTCAAGGAGTTGCTTGGAATCACCATTATGGAGCGTAGCTCCTTCGAGAAGAACCCGATTGACTT

TCTGGAAGCCAAAGGATATAAAGAGGTCAAGAAAGATCTTATCATTAAGCTGCCTAAGTATTCACTCTTCGAGCTGG

AAAATGGTCGTAAACGCATGCTCGCTTCTGCCGGCGAGTTGCAGAAGGGCAATGAATTAGCACTTCCATCAAAGTAC

GTTAACTTCCTGTATTTGGCCAGCCATTACGAGAAACTGAAGGGGTCTCCAGAGGACAACGAACAGAAACAATTATT

TGTAGAGCAGCACAAGCATTATCTTGATGAAATCATTGAGCAAATTTCCGAATTCAGTAAACGCGTAATCCTGGCCG

ATGCAAACCTCGACAAGGTGCTGAGCGCTTACAATAAGCATCGCGACAAACCTATCCGTGAGCAGGCTGAAAATATC

ATTCACCTGTTCACATTAACGAACCTGGGCGCTCCGGCCGCTTTTAAATATTTCGACACGACAATCGACCGTAAGCG

CTATACCAGTACGAAAGAAGTGTTGGATGCGACCCTTATTCACCAGTCAATTACAGGATTATATGAGACCCGTATCG

ACCTTAGCCAATTAGGTGGGGATTTAGAGGCTGAGGCTGCTGCCAAGGAGGCTGCTGCGAAGGAAGCTGCAGCTAAA

GAGGCAGCGGCCAAAGCACTTGAGGCCGAAGCCGCCGCGAAAGAAGCCGCTGCTAAGGAGGCAGCCGCCAAAGAAGC

GGCAGCTAAAGCATTAGAAATGGTTAGCAAAGGTGAAGAACTGTTTACCGGCGTTGTGCCGATTCTGGTGGAACTGG

ATGGTGATGTGAATGGCCATAAATTTAGCGTTagcGGCGAAGGCGAAGGTGATGCGACCtatGGTAAACTGACCCTG

AAATTTATTTGCACCACCGGTAAACTGCCGGTTCCGTGGCCGACCCTGGTGACCACCCTGACCTATGGCGTTCAGTG

CTTTAGCCGCTATCCGGATCATATGAAAcagCATGATTTCTTTAAAAGCGCGATGCCGGAAGGCTATGTGCAGGAAC

GTACCATTtttTTCAAAGATGATGGCaacTATAAAACCCGTGCGGAAGTTAAATTTGAAGGCGATACCCTGGTGAAC

CGCATTGAACTGAAAGGTATTGATTTTAAAGAAGATGGCAACATTCTGGGTCATAAACTGGAATATAATtacAACAG

CCATAATGTGTATATTatgGCCGATAAACAGAAAAATGGCATCAAAgtgAACTTTAAAATCCGTCACAACattGAAG

ATGGTAGCGTGCAGCTGGCGGATCATTATCAGCAGAATACCCCGATTGGTGATGGCCCGGTGCTGCTGCCGGATAAT

CATTATCTGAGCACCCAGAGCgcgCTGAGCAAAGATCCGAATGAAAAACGTGATCATATGGTGCTGCTGGAATTTGT

TACCGCCGCGGGCATTACCctgGGTATGGATGAACTGTATAAA (Cas9-APA-eGFP chimera DNA sequence)
                                                                  SEQ ID NO: 354
ATGGACAAAAAGTACTCTATTGGCCTGGATATCGGGACCAACAGCGTCGGGTGGGCTGTTATCACCGACGAGTATAA

AGTACCTTCGAAAAAGTTCAAAGTGCTGGGCAACACCGATCGCCATTCAATCAAAAAGAACTTGATTGGTGCGCTGT

TGTTTGACTCCGGGGAAACCGCCGAGGCGACTCGCCTTAAACGTACAGCACGTCGCCGGTACACTCGGCGTAAGAAT

CGCATTTGCTATTTGCAGGAAATCTTTAGCAACGAGATGGCAAAGTCGATGACTCGTTTTTCCACCGCCTCGAGGA

AAGCTTTCTGGTGGAGGAAGACAAAAAGCATGAGCGTCACCCGATCTTCGGCAACATTGTCGATGAAGTAGCGTATC

ATGAAAAATACCCAACCATTTACCACTTACGCAAAAAGCTGGTGGACAGCACTGACAAAGCTGATTTGCGCCTTATC

TATTTAGCCCTGGCACATATGATTAAGTTTCGTGGTCACTTCCTGATCGAAGGAGACTTAAATCCCGACAACAGTGA

TGTTGATAAATTGTTTATTCAGCTTGTCCAAACTTACAATCAACTGTTCGAGGAAAACCCGATCAATGCCTCCGGTG

TGGATGCAAAAGCCATTTTAAGTGCACGCCTTAGCAAGTCCCGTCGCTTAGAAAACCTTATCGCGCAGCTGCCCGGC

GAGAAAAGAATGGTTTGTTTGGGAACCTTATTGCCTTGAGCTTAGGCCTCACCCCGAATTTCAAAAGTAATTTCGA

TCTTGCAGAAGACGCCAAATTACAACTGTCGAAGGATACTTATGATGACGATCTCGATAATCTGTTAGCGCAGATTG

GTGACCAATACGCCGATCTTTTTCTGGCGGCTAAAAATCTGAGCGACGCCATCTTGCTTTCGGATATTCTCCGCGTT

AACACCGAAATCACGAAAGCGCCTCTTAGTGCCAGCATGATTAAACGTTATGATGAACACCACCAGGACCTGACCTT

ACTCAAAGCGTTGGTTCGCCAGCAACTGCCAGAGAAGTACAAAGAAATCTTCTTTGATCAGTCAAAGAATGGTTATG

CCGGCTATATTGACGGGGGTGCAAGCCAAGAGGAATTCTACAAATTTATCAAGCCTATTCTGGAGAAAATGGATGGC

ACCGAAGAGTTATTGGTGAAGCTTAACCGTGAAGACCTCCTGCGGAAACAGCGCACATTCGATAATGGTTCGATCCC

ACACCAAATCCATTTGGGGGAGTTACACGCTATTTTGCGTCGCCAGGAAGACTTTTACCCTTTCCTGAAGGATAACC
```

-continued

```
GGGAGAAAATTGAGAAGATCCTTACCTTTCGTATTCCGTATTACGTAGGCCCCTTAGCACGGGGTAATAGCCGTTTC

GCGTGGATGACACGGAAGTCGGAAGAGACGATCACCCCGTGGAACTTCGAAGAGGTAGTCGACAAGGGCGCATCAGC

GCAGTCTTTTATTGAACGTATGACGAATTTCGATAAAAACTTGCCCAATGAGAAGGTGCTTCCGAAACATTCCTTGT

TATATGAATATTTTACAGTTTACAACGAGCTGACCAAGGTTAAATACGTGACGGAAGGAATGCGCAAGCCCGCTTTT

CTTAGCGGTGAGCAAAAAAGGCGATCGTCGACCTGTTATTCAAAACGAATCGTAAGGTGACTGTAAAGCAACTCAA

AGAAGATTACTTCAAAAAGATTGAGTGCTTCGACAGCGTCGAAATCTCTGGGGTAGAGGATCGGTTTAACGCAAGTT

TAGGTACCTACCATGACCTGCTTAAAATCATTAAGGATAAAGACTTCTTAGATAATGAAGAGAACGAAGATATTCTC

GAGGACATCGTCTTGACGTTAACCTTATTTGAGGATCGTGAAATGATTGAGGAACGCCTCAAAACTTATGCCCACCT

GTTCGACGATAAGGTGATGAAGCAGCTGAAACGTCGGCGCTACACAGGATGGGGCCGCTTGAGTCGCAAACTTATTA

ACGGAATCCGTGACAAGCAATCCGGCAAAACGATTCTGGATTTCTTGAAGTCGGACGGATTTGCTAATCGCAACTTC

ATGCAGTTGATCCATGATGACTCCCTGACTTTTAAAGAGGATATTCAAAAGGCGCAGGTTAGTGGTCAAGGCGACAG

CTTACACGAACACATCGCAAATTTGGCTGGTTCGCCGGCCATTAAAAAGGGGATCCTCCAGACCGTGAAAGTTGTAG

ATGAGCTTGTTAAGGTCATGGGTCGTCATAAGCCCGAAAACATCGTGATTGAAATGGCGCGGGAGAATCAAACGACC

CAGAAAGGACAAAAGAATAGCCGTGAACGGATGAAGCGGATCGAGGAAGGCATTAAAGAGCTGGGGTCTCAAATCTT

GAAGGAACACCCTGTGGAGAACACTCAGCTCCAAAATGAAAAACTTTACCTGTACTATTTGCAGAACGGACGCGATA

TGTACGTGGACCAAGAGTTGGATATTAATCGGCTGAGTGACTACGACGTTGATCATATCGTCCCGCAGAGCTTCCTC

AAAGACGATTCTATTGACAATAAGGTACTGACGCGCTCTGATAAAAACCGTGGTAAGTCGGACAACGTGCCCTCCGA

AGAGGTTGTGAAAAAGATGAAAAATTATTGGCGCCAGCTTTTAAACGCGAAGCTGATCACACAACGTAAATTCGATA

ATTTGACCAAGGCTGAACGGGGTGGCCTGAGCGAGTTAGATAAGGCAGGATTTATTAAACGCCAGTTAGTGGAGACT

CGTCAAATCACCAAACATGTCGCGCAGATTTTGGACAGCCGGATGAACACCAAGTACGATGAAAATGACAAACTGAT

CCGTGAGGTGAAAGTCATTACTCTGAAGTCCAAATTAGTTAGTGATTTCCGGAAGGACTTTCAATTCTACAAAGTCC

GTGAAATTAATAACTATCATCACGCACATGACGCGTACCTGAATGCAGTGGTTGGGACCGCCCTTATCAAGAAATAT

CCTAAGCTGGAGTCGGAGTTTGTCTATGGCGACTATAAGGTATACGATGTTCGCAAAATGATTGCGAAATCTGAGCA

GGAGATCGGTAAGGCAACCGCAAAATATTTCTTTTACTCAAACATTATGAATTTCTTTAAGACAGAAATCACTCTGG

CCAACGGGGAGATTCGCAAACGTCCGTTGATCGAAACAAACGGCGAGACTGGCGAAATTGTTTGGGACAAAGGGCGT

GATTTCGCGACGGTGCGCAAGGTACTGAGCATGCCTCAAGTCAATATTGTTAAGAAAACCGAAGTGCAGACGGGCGG

GTTTTCCAAGGAAAGCATCTTACCCAAACGTAATTCAGATAAACTTATTGCACGCAAAAAGGACTGGGATCCGAAAA

AGTATGGAGGCTTCGACAGTCCAACCGTAGCCTACTCTGTTCTCGTTGTAGCGAAAGTAGAAAAGGGTAAATCCAAG

AAACTGAAATCTGTCAAGGAGTTGCTTGGAATCACCATTATGGAGCGTAGCTCCTTCGAGAAGAACCCGATTGACTT

TCTGGAAGCCAAAGGATATAAAGAGGTCAAGAAAGATCTTATCATTAAGCTGCCTAAGTATTCACTCTTCGAGCTGG

AAAATGGTCGTAAACGCATGCTCGCTTCTGCCGGCGAGTTGCAGAAGGGCAATGAATTAGCACTTCCATCAAAGTAC

GTTAACTTCCTGTATTTGGCCAGCCATTACGAGAAACTGAAGGGGTCTCCAGAGGACAACGAACAGAAACAATTATT

TGTAGAGCAGCACAAGCATTATCTTGATGAAATCATTGAGCAAATTTCCGAATTCAGTAAACGCGTAATCCTGGCCG

ATGCAAACCTCGACAAGGTGCTGAGCGCTTACAATAAGCATCGCGACAAACCTATCCGTGAGCAGGCTGAAAATATC

ATTCACCTGTTCACATTAACGAACCTGGGCGCTCCGGCCGCTTTTAAATATTTCGACACGACAATCGACCGTAAGCG

CTATACCAGTACGAAAGAAGTGTTGGATGCGACCCTTATTCACCAGTCAATTACAGGATTATATGAGACCCGTATCG

ACCTTAGCCAATTAGGTGGGGATGCACCTGCGATGGTTAGCAAAGGTGAAGAACTGTTTACCGGCGTTGTGCCGATT

CTGGTGGAACTGGATGGTGATGTGAATGGCCATAAATTTAGCGTTagcGGCGAAGGCGAAGGTGATGCGACCtatGG

TAAACTGACCCTGAAATTTATTTGCACCACCGGTAAACTGCCGGTTCCGTGGCCGACCCTGGTGACCACCCTGACCT

ATGGCGTTCAGTGCTTTAGCCGCTATCCGGATCATATGAAAcagCATGATTTCTTTAAAAGCGCGATGCCGGAAGGC

TATGTGCAGGAACGTACCATTtttTTCAAAGATGATGGCaacTATAAAACCCGTGCGGAAGTTAAATTTGAAGGCGA
```

TACCCTGGTGAACCGCATTGAACTGAAAGGTATTGATTTTAAAGAAGATGGCAACATTCTGGGTCATAAACTGGAAT

ATAATtacAACAGCCATAATGTGTATATTatgGCCGATAAACAGAAAAATGGCATCAAAgtgAACTTTAAAATCCGT

CACAACattGAAGATGGTAGCGTGCAGCTGGCGGATCATTATCAGCAGAATACCCCGATTGGTGATGGCCCGGTGCT

GCTGCCGGATAATCATTATCTGAGCACCCAGAGCgcgCTGAGCAAAGATCCGAATGAAAAACGTGATCATATGGTGC

TGCTGGAATTTGTTACCGCCGCGGGCATTACCctgGGTATGGATGAACTGTATAAA (Cas9-APAPA-eGFP chimera DNA sequence)

SEQ ID NO: 355

ATGGACAAAAAGTACTCTATTGGCCTGGATATCGGGACCAACAGCGTCGGGTGGGCTGTTATCACCGACGAGTATAA

AGTACCTTCGAAAAAGTTCAAAGTGCTGGGCAACACCGATCGCCATTCAATCAAAAAGAACTTGATTGGTGCGCTGT

TGTTTGACTCCGGGGAAACCGCCGAGGCGACTCGCCTTAAACGTACAGCACGTCGCCGGTACACTCGGCGTAAGAAT

CGCATTTGCTATTTGCAGGAAATCTTTAGCAACGAGATGGCAAAAGTCGATGACTCGTTTTTCCACCGCCTCGAGGA

AAGCTTTCTGGTGGAGGAAGACAAAAAGCATGAGCGTCACCCGATCTTCGGCAACATTGTCGATGAAGTAGCGTATC

ATGAAAATACCCAACCATTTACCACTTACGCAAAAAGCTGGTGGACAGCACTGACAAAGCTGATTTGCGCCTTATC

TATTTAGCCCTGGCACATATGATTAAGTTTCGTGGTCACTTCCTGATCGAAGGAGACTTAAATCCCGACAACAGTGA

TGTTGATAAATTGTTTATTCAGCTTGTCCAAACTTACAATCAACTGTTCGAGGAAAACCCGATCAATGCCTCCGGTG

TGGATGCAAAAGCCATTTTAAGTGCACGCCTTAGCAAGTCCCGTCGCTTAGAAAACCTTATCGCGCAGCTGCCCGGC

GAGAAAAAGAATGGTTTGTTTGGGAACCTTATTGCCTTGAGCTTAGGCCTCACCCCGAATTTCAAAAGTAATTTCGA

TCTTGCAGAAGACGCCAAATTACAACTGTCGAAGGATACTTATGATGACGATCTCGATAATCTGTTAGCGCAGATTG

GTGACCAATACGCCGATCTTTTTCTGGCGGCTAAAAATCTGAGCGACGCCATCTTGCTTTCGGATATTCTCCGCGTT

AACACCGAAATCACGAAAGCGCCTCTTAGTGCCAGCATGATTAAACGTTATGATGAACACCACCAGGACCTGACCTT

ACTCAAAGCGTTGGTTCGCCAGCAACTGCCAGAGAAGTACAAAGAAATCTTCTTTGATCAGTCAAAGAATGGTTATG

CCGGCTATATTGACGGGGGTGCAAGCCAAGAGGAATTCTACAAATTTATCAAGCCTATTCTGGAGAAAATGGATGGC

ACCGAAGAGTTATTGGTGAAGCTTAACCGTGAAGACCTCCTGCGGAAACAGCGCACATTCGATAATGGTTCGATCCC

ACACCAAATCCATTTGGGGAGTTACACGCTATTTTGCGTCGCCAGGAAGACTTTTACCCTTTCCTGAAGGATAACC

GGGAGAAAATTGAGAAGATCCTTACCTTTCGTATTCCGTATTACGTAGGCCCCTTAGCACGGGGTAATAGCCGTTTC

GCGTGGATGACACGGAAGTCGGAAGAGACGATCACCCCGTGGAACTTCGAAGAGGTAGTCGACAAGGGCGCATCAGC

GCAGTCTTTTATTGAACGTATGACGAATTTCGATAAAAACTTGCCCAATGAGAAGGTGCTTCCGAAACATTCCTTGT

TATATGAATATTTTACAGTTTACAACGAGCTGACCAAGGTTAATACGTGACGGAAGGAATGCGCAAGCCCGCTTTT

CTTAGCGGTGAGCAAAAAAGGCGATCGTCGACCTGTTATTCAAAACGAATCGTAAGGTGACTGTAAAGCAACTCAA

AGAAGATTACTTCAAAAAGATTGAGTGCTTCGACAGCGTCGAAATCTCTGGGGTAGAGGATCGGTTTAACGCAAGTT

TAGGTACCTACCATGACCTGCTTAAAATCATTAAGGATAAAGACTTCTTAGATAATGAAGAGAACGAAGATATTCTC

GAGGACATCGTCTTGACGTTAACCTTATTTGAGGATCGTGAAATGATTGAGGAACGCCTCAAAACTTATGCCCACCT

GTTCGACGATAAGGTGATGAAGCAGCTGAAACGTCGGCGCTACACAGGATGGGGCCGCTTGAGTCGCAAACTTATTA

ACGGAATCCGTGACAAGCAATCCGGCAAAACGATTCTGGATTTCTTGAAGTCGGACGGATTTGCTAATCGCAACTTC

ATGCAGTTGATCCATGATGACTCCCTGACTTTTAAAGAGGATATTCAAAAGGCGCAGGTTAGTGGTCAAGGCGACAG

CTTACACGAACACATCGCAAATTTGGCTGGTTCGCCGGCCATTAAAAGGGGATCCTCCAGACCGTGAAAGTTGTAG

ATGAGCTTGTTAAGGTCATGGGTCGTCATAAGCCCGAAAACATCGTGATTGAAATGGCGCGGGAGAATCAAACGACC

CAGAAAGGACAAAAGAATAGCCGTGAACGGATGAAGCGGATCGAGGAAGGCATTAAAGAGCTGGGGTCTCAAATCTT

GAAGGAACACCCTGTGGAGAACACTCAGCTCCAAAATGAAAAACTTTACCTGTACTATTTGCAGAACGGACGCGATA

TGTACGTGGACCAAGAGTTGGATATTAATCGGCTGAGTGACTACGACGTTGATCATATCGTCCCGCAGAGCTTCCTC

AAAGACGATTCTATTGACAATAAGGTACTGACGCGCTCTGATAAAAACCGTGGTAAGTCGGACAACGTGCCCTCCGA

-continued

AGAGGTTGTGAAAAAGATGAAAAATTATTGGCGCCAGCTTTTAAACGCGAAGCTGATCACACAACGTAAATTCGATA
ATTTGACCAAGGCTGAACGGGGTGGCCTGAGCGAGTTAGATAAGGCAGGATTTATTAAACGCCAGTTAGTGGAGACT
CGTCAAATCACCAAACATGTCGCGCAGATTTTGGACAGCCGGATGAACACCAAGTACGATGAAAATGACAAACTGAT
CCGTGAGGTGAAAGTCATTACTCTGAAGTCCAAATTAGTTAGTGATTTCCGGAAGGACTTTCAATTCTACAAAGTCC
GTGAAATTAATAACTATCATCACGCACATGACGCGTACCTGAATGCAGTGGTTGGGACCGCCCTTATCAAGAAATAT
CCTAAGCTGGAGTCGGAGTTTGTCTATGGCGACTATAAGGTATACGATGTTCGCAAAATGATTGCGAAATCTGAGCA
GGAGATCGGTAAGGCAACCGCAAAATATTTCTTTTACTCAAACATTATGAATTTCTTTAAGACAGAAATCACTCTGG
CCAACGGGGAGATTCGCAAACGTCCGTTGATCGAAACAAACGGCGAGACTGGCGAAATTGTTTGGGACAAAGGGCGT
GATTTCGCGACGGTGCGCAAGGTACTGAGCATGCCTCAAGTCAATATTGTTAAGAAAACCGAAGTGCAGACGGGCGG
GTTTTCCAAGGAAAGCATCTTACCCAAACGTAATTCAGATAAACTTATTGCACGCAAAAAGGACTGGGATCCGAAAA
AGTATGGAGGCTTCGACAGTCCAACCGTAGCCTACTCTGTTCTCGTTGTAGCGAAAGTAGAAAAGGGTAAATCCAAG
AAACTGAAATCTGTCAAGGAGTTGCTTGGAATCACCATTATGGAGCGTAGCTCCTTCGAGAAGAACCCGATTGACTT
TCTGGAAGCCAAAGGATATAAAGAGGTCAAGAAAGATCTTATCATTAAGCTGCCTAAGTATTCACTCTTCGAGCTGG
AAAATGGTCGTAAACGCATGCTCGCTTCTGCCGGCGAGTTGCAGAAGGGCAATGAATTAGCACTTCCATCAAAGTAC
GTTAACTTCCTGTATTTGGCCAGCCATTACGAGAAACTGAAGGGGTCTCCAGAGGACAACGAACAGAAACAATTATT
TGTAGAGCAGCACAAGCATTATCTTGATGAAATCATTGAGCAAATTTCCGAATTCAGTAAACGCGTAATCCTGGCCG
ATGCAAACCTCGACAAGGTGCTGAGCGCTTACAATAAGCATCGCGACAAACCTATCCGTGAGCAGGCTGAAAATATC
ATTCACCTGTTCACATTAACGAACCTGGGCGCTCCGGCCGCTTTTAAATATTTCGACACGACAATCGACCGTAAGCG
CTATACCAGTACGAAAGAAGTGTTGGATGCGACCCTTATTCACCAGTCAATTACAGGATTATATGAGACCCGTATCG
ACCTTAGCCAATTAGGTGGGGATGCTCCTGCACCTGCGATGGTTAGCAAAGGTGAAGAACTGTTTACCGGCGTTGTG
CCGATTCTGGTGGAACTGGATGGTGATGTGAATGGCCATAAATTTAGCGTTagcGGCGAAGGCGAAGGTGATGCGAC
CtatGGTAAACTGACCCTGAAATTTATTTGCACCACCGGTAAACTGCCGGTTCCGTGGCCGACCCTGGTGACCACCC
TGACCTATGGCGTTCAGTGCTTTAGCCGCTATCCGGATCATATGAAAcagCATGATTTCTTTAAAAGCGCGATGCCG
GAAGGCTATGTGCAGGAACGTACCATTtttTTCAAAGATGATGGCaacTATAAAACCCGTGCGGAAGTTAAATTTGA
AGGCGATACCCTGGTGAACCGCATTGAACTGAAAGGTATTGATTTTAAAGAAGATGGCAACATTCTGGGTCATAAAC
TGGAATATAATtacAACAGCCATAATGTGTATATTatgGCCGATAAACAGAAAAATGGCATCAAAgtgAACTTTAAA
ATCCGTCACAACCattGAAGATGGTAGCGTGCAGCTGGCGGATCATTATCAGCAGAATACCCCGATTGGTGATGGCCC
GGTGCTGCTGCCGGATAATCATTATCTGAGCACCCAGAGCgcgCTGAGCAAAGATCCGAATGAAAAACGTGATCATA
TGGTGCTGCTGGAATTTGTTACCGCCGCGGGCATTACCctgGGTATGGATGAACTGTATAAA (Cas9-APAPAPA-eGFP chimera DNA sequence)

SEQ ID NO: 356

ATGGACAAAAAGTACTCTATTGGCCTGGATATCGGGACCAACAGCGTCGGGTGGGCTGTTATCACCGACGAGTATAA
AGTACCTTCGAAAAAGTTCAAAGTGCTGGGCAACACCGATCGCCATTCAATCAAAAAGAACTTGATTGGTGCGCTGT
TGTTTGACTCCGGGGAAACCGCCGAGGCGACTCGCCTTAAACGTACAGCACGTCGCCGGTACACTCGGCGTAAGAAT
CGCATTTGCTATTTGCAGGAAATCTTTAGCAACGAGATGGCAAAAGTCGATGACTCGTTTTTCCACCGCCTCGAGGA
AAGCTTTCTGGTGGAGGAAGACAAAAAGCATGAGCGTCACCCGATCTTCGGCAACATTGTCGATGAAGTAGCGTATC
ATGAAAAATACCCAACCATTTACCACTTACGCAAAAAGCTGGTGGACAGCACTGACAAAGCTGATTTGCGCCTTATC
TATTTAGCCCTGGCACATATGATTAAGTTTCGTGGTCACTTCCTGATCGAAGGAGACTTAAATCCCGACAACAGTGA
TGTTGATAAATTGTTTATTCAGCTTGTCCAAACTTACAATCAACTGTTCGAGGAAAACCCGATCAATGCCTCCGGTG
TGGATGCAAAAGCCATTTTAAGTGCACGCCTTAGCAAGTCCCGTCGCTTAGAAAACCTTATCGCGCAGCTGCCCGGC
GAGAAAAAGAATGGTTTGTTTGGGAACCTTATTGCCTTGAGCTTAGGCCTCACCCCGAATTTCAAAAGTAATTTCGA
TCTTGCAGAAGACGCCAAATTACAACTGTCGAAGGATACTTATGATGACGATCTCGATAATCTGTTAGCGCAGATTG

-continued

```
GTGACCAATACGCCGATCTTTTTCTGGCGGCTAAAAATCTGAGCGACGCCATCTTGCTTTCGGATATTCTCCGCGTT

AACACCGAAATCACGAAAGCGCCTCTTAGTGCCAGCATGATTAAACGTTATGATGAACACCACCAGGACCTGACCTT

ACTCAAAGCGTTGGTTCGCCAGCAACTGCCAGAGAAGTACAAAGAAATCTTCTTTGATCAGTCAAAGAATGGTTATG

CCGGCTATATTGACGGGGGTGCAAGCCAAGAGGAATTCTACAAATTTATCAAGCCTATTCTGGAGAAAATGGATGGC

ACCGAAGAGTTATTGGTGAAGCTTAACCGTGAAGACCTCCTGCGGAAACAGCGCACATTCGATAATGGTTCGATCCC

ACACCAAATCCATTTGGGGGAGTTACACGCTATTTTGCGTCGCCAGGAAGACTTTTACCCTTTCCTGAAGGATAACC

GGGAGAAAATTGAGAAGATCCTTACCTTTCGTATTCCGTATTACGTAGGCCCCTTAGCACGGGGTAATAGCCGTTTC

GCGTGGATGACACGGAAGTCGGAAGAGACGATCACCCCGTGGAACTTCGAAGAGGTAGTCGACAAGGGCGCATCAGC

GCAGTCTTTTATTGAACGTATGACGAATTTCGATAAAAACTTGCCCAATGAGAAGGTGCTTCCGAAACATTCCTTGT

TATATGAATATTTTACAGTTTACAACGAGCTGACCAAGGTTAAATACGTGACGGAAGGAATGCGCAAGCCCGCTTTT

CTTAGCGGTGAGCAAAAAAGGCGATCGTCGACCTGTTATTCAAAACGAATCGTAAGGTGACTGTAAAGCAACTCAA

AGAAGATTACTTCAAAAAGATTGAGTGCTTCGACAGCGTCGAAATCTCTGGGGTAGAGGATCGGTTTAACGCAAGTT

TAGGTACCTACCATGACCTGCTTAAAATCATTAAGGATAAAGACTTCTTAGATAATGAAGAGAACGAAGATATTCTC

GAGGACATCGTCTTGACGTTAACCTTATTTGAGGATCGTGAAATGATTGAGGAACGCCTCAAAACTTATGCCCACCT

GTTCGACGATAAGGTGATGAAGCAGCTGAAACGTCGGCGCTACACAGGATGGGGCCGCTTGAGTCGCAAACTTATTA

ACGGAATCCGTGACAAGCAATCCGGCAAAACGATTCTGGATTTCTTGAAGTCGGACGGATTTGCTAATCGCAACTTC

ATGCAGTTGATCCATGATGACTCCCTGACTTTTAAAGAGGATATTCAAAAGGCGCAGGTTAGTGGTCAAGGCGACAG

CTTACACGAACACATCGCAAATTTGGCTGGTTCGCCGGCCATTAAAAAGGGGATCCTCCAGACCGTGAAAGTTGTAG

ATGAGCTTGTTAAGGTCATGGGTCGTCATAAGCCCGAAAACATCGTGATTGAAATGGCGCGGGAGAATCAAACGACC

CAGAAAGGACAAAAGAATAGCCGTGAACGGATGAAGCGGATCGAGGAAGGCATTAAAGAGCTGGGGTCTCAAATCTT

GAAGGAACACCCTGTGGAGAACACTCAGCTCCAAAATGAAAAACTTTACCTGTACTATTTGCAGAACGGACGCGATA

TGTACGTGGACCAAGAGTTGGATATTAATCGGCTGAGTGACTACGACGTTGATCATATCGTCCCGCAGAGCTTCCTC

AAAGACGATTCTATTGACAATAAGGTACTGACGCGCTCTGATAAAAACCGTGGTAAGTCGGACAACGTGCCCTCCGA

AGAGGTTGTGAAAAAGATGAAAAATTATTGGCGCCAGCTTTTAAACGCGAAGCTGATCACACAACGTAAATTCGATA

ATTTGACCAAGGCTGAACGGGGTGGCCTGAGCGAGTTAGATAAGGCAGGATTTATTAAACGCCAGTTAGTGGAGACT

CGTCAAATCACCAAACATGTCGCGCAGATTTTGGACAGCCGGATGAACACCAAGTACGATGAAAATGACAAACTGAT

CCGTGAGGTGAAAGTCATTACTCTGAAGTCCAAATTAGTTAGTGATTTCCGGAAGGACTTTCAATTCTACAAAGTCC

GTGAAATTAATAACTATCATCACGCACATGACGCGTACCTGAATGCAGTGGTTGGGACCGCCCTTATCAAGAAATAT

CCTAAGCTGGAGTCGGAGTTTGTCTATGGCGACTATAAGGTATACGATGTTCGCAAAATGATTGCGAAATCTGAGCA

GGAGATCGGTAAGGCAACCGCAAAATATTTCTTTTACTCAAACATTATGAATTTCTTTAAGACAGAAATCACTCTGG

CCAACGGGAGATTCGCAAACGTCCGTTGATCGAAACAAACGGCGAGACTGGCGAAATTGTTTGGGACAAAGGGCGT

GATTTCGCGACGGTGCGCAAGGTACTGAGCATGCCTCAAGTCAATATTGTTAAGAAAACCGAAGTGCAGACGGGCGG

GTTTTCCAAGGAAAGCATCTTACCCAAACGTAATTCAGATAAACTTATTGCACGCAAAAAGGACTGGGATCCGAAAA

AGTATGGAGGCTTCGACAGTCCAACCGTAGCCTACTCTGTTCTCGTTGTAGCGAAAGTAGAAAAGGGTAAATCCAAG

AAACTGAAATCTGTCAAGGAGTTGCTTGGAATCACCATTATGGAGCGTAGCTCCTTCGAGAAGAACCCGATTGACTT

TCTGGAAGCCAAAGGATATAAAGAGGTCAAGAAGATCTTATCATTAAGCTGCCTAAGTATTCACTCTTCGAGCTGG

AAAATGGTCGTAAACGCATGCTCGCTTCTGCCGGCGAGTTGCAGAAGGGCAATGAATTAGCACTTCCATCAAAGTAC

GTTAACTTCCTGTATTTGGCCAGCCATTACGAGAAACTGAAGGGGTCTCCAGAGGACAACGAACAGAAACAATTATT

TGTAGAGCAGCACAAGCATTATCTTGATGAAATCATTGAGCAAATTTCCGAATTCAGTAAACGCGTAATCCTGGCCG

ATGCAAACCTCGACAAGGTGCTGAGCGCTTACAATAAGCATCGCGACAAACCTATCCGTGAGCAGGCTGAAAATATC
```

-continued

ATTCACCTGTTCACATTAACGAACCTGGGCGCTCCGGCCGCTTTTAAATATTTCGACACGACAATCGACCGTAAGCG

CTATACCAGTACGAAAGAAGTGTTGGATGCGACCCTTATTCACCAGTCAATTACAGGATTATATGAGACCCGTATCG

ACCTTAGCCAATTAGGTGGGGATGCGCCAGCTCCTGCACCTGCGATGGTTAGCAAAGGTGAAGAACTGTTTACCGGC

GTTGTGCCGATTCTGGTGGAACTGGATGGTGATGTGAATGGCCATAAATTTAGCGTTagcGGCGAAGGCGAAGGTGA

TGCGACCtatGGTAAACTGACCCTGAAATTTATTTGCACCACCGGTAAACTGCCGGTTCCGTGGCCGACCCTGGTGA

CCACCCTGACCTATGGCGTTCAGTGCTTTAGCCGCTATCCGGATCATATGAAAcagCATGATTTCTTTAAAAGCGCG

ATGCCGGAAGGCTATGTGCAGGAACGTACCATTtttTTCAAAGATGATGGCaacTATAAAACCCGTGCGGAAGTTAA

ATTTGAAGGCGATACCCTGGTGAACCGCATTGAACTGAAAGGTATTGATTTTAAAGAAGATGGCAACATTCTGGGTC

ATAAACTGGAATATAATtacAACAGCCATAATGTGTATATTatgGCCGATAAACAGAAAAATGGCATCAAAgtgAAC

TTTAAAATCCGTCACAACattGAAGATGGTAGCGTGCAGCTGGCGGATCATTATCAGCAGAATACCCCGATTGGTGA

TGGCCCGGTGCTGCTGCCGGATAATCATTATCTGAGCACCCAGAGCgcgCTGAGCAAAGATCCGAATGAAAAACGTG

ATCATATGGTGCTGCTGGAATTTGTTACCGCCGCGGGCATTACCctgGGTATGGATGAACTGTATAAA (Cas9-APAPAPAPA-eGFP chimera DNA sequence)

SEQ ID NO: 357

ATGGACAAAAAGTACTCTATTGGCCTGGATATCGGGACCAACAGCGTCGGGTGGGCTGTTATCACCGACGAGTATAA

AGTACCTTCGAAAAAGTTCAAAGTGCTGGGCAACACCGATCGCCATTCAATCAAAAAGAACTTGATTGGTGCGCTGT

TGTTTGACTCCGGGGAAACCGCCGAGGCGACTCGCCTTAAACGTACAGCACGTCGCCGGTACACTCGGCGTAAGAAT

CGCATTTGCTATTTGCAGGAAATCTTTAGCAACGAGATGGCAAAAGTCGATGACTCGTTTTTCCACCGCCTCGAGGA

AAGCTTTCTGGTGGAGGAAGACAAAAAGCATGAGCGTCACCCGATCTTCGGCAACATTGTCGATGAAGTAGCGTATC

ATGAAAAATACCCAACCATTTACCACTTACGCAAAAAGCTGGTGGACAGCACTGACAAAGCTGATTTGCGCCTTATC

TATTTAGCCCTGGCACATATGATTAAGTTTCGTGGTCACTTCCTGATCGAAGGAGACTTAAATCCCGACAACAGTGA

TGTTGATAAATTGTTTATTCAGCTTGTCCAAACTTACAATCAACTGTTCGAGGAAAACCCGATCAATGCCTCCGGTG

TGGATGCAAAAGCCATTTTAAGTGCACGCCTTAGCAAGTCCCGTCGCTTAGAAAACCTTATCGCGCAGCTGCCCGGC

GAGAAAAAGAATGGTTTGTTTGGGAACCTTATTGCCTTGAGCTTAGGCCTCACCCCGAATTTCAAAAGTAATTTCGA

TCTTGCAGAAGACGCCAAATTACAACTGTCGAAGGATACTTATGATGACGATCTCGATAATCTGTTAGCGCAGATTG

GTGACCAATACGCCGATCTTTTTCTGGCGGCTAAAAATCTGAGCGACGCCATCTTGCTTTCGGATATTCTCCGCGTT

AACACCGAAATCACGAAAGCGCCTCTTAGTGCCAGCATGATTAAACGTTATGATGAACACCACCAGGACCTGACCTT

ACTCAAAGCGTTGGTTCGCCAGCAACTGCCAGAGAAGTACAAAGAAATCTTCTTTGATCAGTCAAAGAATGGTTATG

CCGGCTATATTGACGGGGGTGCAAGCCAAGAGGAATTCTACAAATTTATCAAGCCTATTCTGGAGAAAATGGATGGC

ACCGAAGAGTTATTGGTGAAGCTTAACCGTGAAGACCTCCTGCGGAAACAGCGCACATTCGATAATGGTTCGATCCC

ACACCAAATCCATTTGGGGGAGTTACACGCTATTTTGCGTCGCCAGGAAGACTTTTACCCTTTCCTGAAGGATAACC

GGGAGAAAATTGAGAAGATCCTTACCTTTCGTATTCCGTATTACGTAGGCCCCTTAGCACGGGGTAATAGCCGTTTC

GCGTGGATGACACGGAAGTCGGAAGAGACGATCACCCCGTGGAACTTCGAAGAGGTAGTCGACAAGGGCGCATCAGC

GCAGTCTTTTATTGAACGTATGACGAATTTCGATAAAAACTTGCCCAATGAGAAGGTGCTTCCGAAACATTCCTTGT

TATATGAATATTTTACAGTTTACAACGAGCTGACCAAGGTTAAATACGTGACGGAAGGAATGCGCAAGCCCGCTTTT

CTTAGCGGTGAGCAAAAAAGGCGATCGTCGACCTGTTATTCAAAACGAATCGTAAGGTGACTGTAAAGCAACTCAA

AGAAGATTACTTCAAAAAGATTGAGTGCTTCGACAGCGTCGAAATCTCTGGGGTAGAGGATCGGTTTAACGCAAGTT

TAGGTACCTACCATGACCTGCTTAAAATCATTAAGGATAAAGACTTCTTAGATAATGAAGAGAACGAAGATATTCTC

GAGGACATCGTCTTGACGTTAACCTTATTTGAGGATCGTGAAATGATTGAGGAACGCCTCAAAACTTATGCCCACCT

GTTCGACGATAAGGTGATGAAGCAGCTGAAACGTCGGCGCTACACAGGATGGGGCCGCTTGAGTCGCAAACTTATTA

ACGGAATCCGTGACAAGCAATCCGGCAAAACGATTCTGGATTTCTTGAAGTCGGACGGATTTGCTAATCGCAACTTC

ATGCAGTTGATCCATGATGACTCCCTGACTTTTAAAGAGGATATTCAAAAGGCGCAGGTTAGTGGTCAAGGCGACAG

```
CTTACACGAACACATCGCAAATTTGGCTGGTTCGCCGGCCATTAAAAAGGGGATCCTCCAGACCGTGAAAGTTGTAG
ATGAGCTTGTTAAGGTCATGGGTCGTCATAAGCCCGAAAACATCGTGATTGAAATGGCGCGGGAGAATCAAACGACC
CAGAAAGGACAAAAGAATAGCCGTGAACGGATGAAGCGGATCGAGGAAGGCATTAAAGAGCTGGGGTCTCAAATCTT
GAAGGAACACCCTGTGGAGAACACTCAGCTCCAAAATGAAAAACTTTACCTGTACTATTTGCAGAACGGACGCGATA
TGTACGTGGACCAAGAGTTGGATATTAATCGGCTGAGTGACTACGACGTTGATCATATCGTCCCGCAGAGCTTCCTC
AAAGACGATTCTATTGACAATAAGGTACTGACGCGCTCTGATAAAACCGTGGTAAGTCGGACAACGTGCCCTCCGA
AGAGGTTGTGAAAAAGATGAAAAATTATTGGCGCCAGCTTTTAAACGCGAAGCTGATCACACAACGTAAATTCGATA
ATTTGACCAAGGCTGAACGGGGTGGCCTGAGCGAGTTAGATAAGGCAGGATTTATTAAACGCCAGTTAGTGGAGACT
CGTCAAATCACCAAACATGTCGCGCAGATTTTGGACAGCCGGATGAACACCAAGTACGATGAAAATGACAAACTGAT
CCGTGAGGTGAAAGTCATTACTCTGAAGTCCAAATTAGTTAGTGATTTCCGGAAGGACTTTCAATTCTACAAAGTCC
GTGAAATTAATAACTATCATCACGCACATGACGCGTACCTGAATGCAGTGGTTGGGACCGCCCTTATCAAGAAATAT
CCTAAGCTGGAGTCGGAGTTTGTCTATGGCGACTATAAGGTATACGATGTTCGCAAAATGATTGCGAAATCTGAGCA
GGAGATCGGTAAGGCAACCGCAAAATATTTCTTTTACTCAAACATTATGAATTTCTTTAAGACAGAAATCACTCTGG
CCAACGGGGAGATTCGCAAACGTCCGTTGATCGAAACAAACGGCGAGACTGGCGAAATTGTTTGGGACAAAGGGCGT
GATTTCGCGACGGTGCGCAAGGTACTGAGCATGCCTCAAGTCAATATTGTTAAGAAAACCGAAGTGCAGACGGGCGG
GTTTTCCAAGGAAAGCATCTTACCCAAACGTAATTCAGATAAACTTATTGCACGCAAAAAGGACTGGGATCCGAAAA
AGTATGGAGGCTTCGACAGTCCAACCGTAGCCTACTCTGTTCTCGTTGTAGCGAAAGTAGAAAAGGGTAAATCCAAG
AAACTGAAATCTGTCAAGGAGTTGCTTGGAATCACCATTATGGAGCGTAGCTCCTTCGAGAAGAACCCGATTGACTT
TCTGGAAGCCAAAGGATATAAAGAGGTCAAGAAAGATCTTATCATTAAGCTGCCTAAGTATTCACTCTTCGAGCTGG
AAAATGGTCGTAAACGCATGCTCGCTTCTGCCGGCGAGTTGCAGAAGGGCAATGAATTAGCACTTCCATCAAAGTAC
GTTAACTTCCTGTATTTGGCCAGCCATTACGAGAAACTGAAGGGGTCTCCAGAGGACAACGAACAGAAACAATTATT
TGTAGAGCAGCACAAGCATTATCTTGATGAAATCATTGAGCAAATTTCCGAATTCAGTAAACGCGTAATCCTGGCCG
ATGCAAACCTCGACAAGGTGCTGAGCGCTTACAATAAGCATCGCGACAAACCTATCCGTGAGCAGGCTGAAAATATC
ATTCACCTGTTCACATTAACGAACCTGGGCGCTCCGGCCGCTTTTAAATATTTCGACACGACAATCGACCGTAAGCG
CTATACCAGTACGAAAGAAGTGTTGGATGCGACCCTTATTCACCAGTCAATTACAGGATTATATGAGACCCGTATCG
ACCTTAGCCAATTAGGTGGGGATGCTCCTGCGCCAGCTCCTGCACCTGCGATGGTTAGCAAAGGTGAAGAACTGTTT
ACCGGCGTTGTGCCGATTCTGGTGGAACTGGATGGTGATGTGAATGGCCATAAATTTAGCGTTagcGGCGAAGGCGA
AGGTGATGCGACCtatGGTAAACTGACCCTGAAATTTATTTGCACCACCGGTAAACTGCCGGTTCCGTGGCCGACCC
TGGTGACCACCCTGACCTATGGCGTTCAGTGCTTTAGCCGCTATCCGGATCATATGAAAcagCATGATTTCTTTAAA
AGCGCGATGCCGGAAGGCTATGTGCAGGAACGTACCATTtttTTCAAAGATGATGGCaacTATAAAACCCGTGCGGA
AGTTAAATTTGAAGGCGATACCCTGGTGAACCGCATTGAACTGAAAGGTATTGATTTTAAAGAAGATGGCAACATTC
TGGGTCATAAACTGGAATATAATtacAACAGCCATAATGTGTATATTatgGCCGATAAACAGAAAAATGGCATCAAA
gtgAACTTTAAAATCCGTCACAACattGAAGATGGTAGCGTGCAGCTGGCGGATCATTATCAGCAGAATACCCCGAT
TGGTGATGGCCCGGTGCTGCTGCCGGATAATCATTATCTGAGCACCCAGAGCGcgCTGAGCAAAGATCCGAATGAAA
AACGTGATCATATGGTGCTGCTGGAATTTGTTACCGCCGCGGGCATTACCctgGGTATGGATGAACTGTATAAA
```
(Cas9-APAPAPAPAPA-eGFP chimera DNA sequence)

SEQ ID NO: 358
```
ATGGACAAAAAGTACTCTATTGGCCTGGATATCGGGACCAACAGCGTCGGGTGGGCTGTTATCACCGACGAGTATAA
AGTACCTTCGAAAAAGTTCAAAGTGCTGGGCAACACCGATCGCCATTCAATCAAAAAGAACTTGATTGGTGCGCTGT
TGTTTGACTCCGGGGAAACCGCCGAGGCGACTCGCCTTAAACGTACAGCACGTCGCCGGTACACTCGGCGTAAGAAT
CGCATTTGCTATTTGCAGGAAATCTTTAGCAACGAGATGGCAAAAGTCGATGACTCGTTTTTCCACCGCCTCGAGGA
```

-continued

```
AAGCTTTCTGGTGGAGGAAGACAAAAAGCATGAGCGTCACCCGATCTTCGGCAACATTGTCGATGAAGTAGCGTATC
ATGAAAAATACCCAACCATTTACCACTTACGCAAAAAGCTGGTGGACAGCACTGACAAAGCTGATTTGCGCCTTATC
TATTTAGCCCTGGCACATATGATTAAGTTTCGTGGTCACTTCCTGATCGAAGGAGACTTAAATCCCGACAACAGTGA
TGTTGATAAATTGTTTATTCAGCTTGTCCAAACTTACAATCAACTGTTCGAGGAAAACCCGATCAATGCCTCCGGTG
TGGATGCAAAAGCCATTTTAAGTGCACGCCTTAGCAAGTCCCGTCGCTTAGAAAACCTTATCGCGCAGCTGCCCGGC
GAGAAAAAGAATGGTTTGTTTGGGAACCTTATTGCCTTGAGCTTAGGCCTCACCCCGAATTTCAAAAGTAATTTCGA
TCTTGCAGAAGACGCCAAATTACAACTGTCGAAGGATACTTATGATGACGATCTCGATAATCTGTTAGCGCAGATTG
GTGACCAATACGCCGATCTTTTTCTGGCGGCTAAAAATCTGAGCGACGCCATCTTGCTTTCGGATATTCTCCGCGTT
AACACCGAAATCACGAAAGCGCCTCTTAGTGCCAGCATGATTAAACGTTATGATGAACACCACCAGGACCTGACCTT
ACTCAAAGCGTTGGTTCGCCAGCAACTGCCAGAGAAGTACAAAGAAATCTTCTTTGATCAGTCAAAGAATGGTTATG
CCGGCTATATTGACGGGGGTGCAAGCCAAGAGGAATTCTACAAATTTATCAAGCCTATTCTGGAGAAAATGGATGGC
ACCGAAGAGTTATTGGTGAAGCTTAACCGTGAAGACCTCCTGCGGAAACAGCGCACATTCGATAATGGTTCGATCCC
ACACCAAATCCATTTGGGGGAGTTACACGCTATTTTGCGTCGCCAGGAAGACTTTTACCCTTTCCTGAAGGATAACC
GGGAGAAAATTGAGAAGATCCTTACCTTTCGTATTCCGTATTACGTAGGCCCCTTAGCACGGGGTAATAGCCGTTTC
GCGTGGATGACACGGAAGTCGGAAGAGACGATCACCCCGTGGAACTTCGAAGAGGTAGTCGACAAGGGCGCATCAGC
GCAGTCTTTTATTGAACGTATGACGAATTTCGATAAAAACTTGCCCAATGAGAAGGTGCTTCCGAAACATTCCTTGT
TATATGAATATTTTACAGTTTACAACGAGCTGACCAAGGTTAAATACGTGACGGAAGGAATGCGCAAGCCCGCTTTT
CTTAGCGGTGAGCAAAAAAGGCGATCGTCGACCTGTTATTCAAAACGAATCGTAAGGTGACTGTAAAGCAACTCAA
AGAAGATTACTTCAAAAAGATTGAGTGCTTCGACAGCGTCGAAATCTCTGGGGTAGAGGATCGGTTTAACGCAAGTT
TAGGTACCTACCATGACCTGCTTAAAATCATTAAGGATAAAGACTTCTTAGATAATGAAGAGAACGAAGATATTCTC
GAGGACATCGTCTTGACGTTAACCTTATTTGAGGATCGTGAAATGATTGAGGAACGCCTCAAAACTTATGCCCACCT
GTTCGACGATAAGGTGATGAAGCAGCTGAAACGTCGGCGCTACACAGGATGGGGCCGCTTGAGTCGCAAACTTATTA
ACGGAATCCGTGACAAGCAATCCGGCAAAACGATTCTGGATTTCTTGAAGTCGGACGGATTTGCTAATCGCAACTTC
ATGCAGTTGATCCATGATGACTCCCTGACTTTTAAAGAGGATATTCAAAAGGCGCAGGTTAGTGGTCAAGGCGACAG
CTTACACGAACACATCGCAAATTTGGCTGGTTCGCCGGCCATTAAAAAGGGGATCCTCCAGACCGTGAAAGTTGTAG
ATGAGCTTGTTAAGGTCATGGGTCGTCATAAGCCCGAAAACATCGTGATTGAAATGGCGCGGGAGAATCAAACGACC
CAGAAAGGACAAAAGAATAGCCGTGAACGGATGAAGCGGATCGAGGAAGGCATTAAAGAGCTGGGGTCTCAAATCTT
GAAGGAACACCCTGTGGAGAACACTCAGCTCCAAAATGAAAAACTTTACCTGTACTATTTGCAGAACGGACGCGATA
TGTACGTGGACCAAGAGTTGGATATTAATCGGCTGAGTGACTACGACGTTGATCATATCGTCCCGCAGAGCTTCCTC
AAAGACGATTCTATTGACAATAAGGTACTGACGCGCTCTGATAAAAACCGTGGTAAGTCGGACAACGTGCCCTCCGA
AGAGGTTGTGAAAAAGATGAAAAATTATTGGCGCCAGCTTTTAAACGCGAAGCTGATCACACAACGTAAATTCGATA
ATTTGACCAAGGCTGAACGGGGTGGCCTGAGCGAGTTAGATAAGGCAGGATTTATTAAACGCCAGTTAGTGGAGACT
CGTCAAATCACCAAACATGTCGCGCAGATTTTGGACAGCCGGATGAACACCAAGTACGATGAAAATGACAAACTGAT
CCGTGAGGTGAAAGTCATTACTCTGAAGTCCAAATTAGTTAGTGATTTCCGGAAGGACTTTCAATTCTACAAAGTCC
GTGAAATTAATAACTATCATCACGCACATGACGCGTACCTGAATGCAGTGGTTGGGACCGCCCTTATCAAGAAATAT
CCTAAGCTGGAGTCGGAGTTTGTCTATGGCGACTATAAGGTATACGATGTTCGCAAAATGATTGCGAAATCTGAGCA
GGAGATCGGTAAGGCAACCGCAAAATATTTCTTTTACTCAAACATTATGAATTTCTTTAAGACAGAAATCACTCTGG
CCAACGGGGAGATTCGCAAACGTCCGTTGATCGAAACAAACGGCGAGACTGGCGAAATTGTTTGGGACAAAGGGCGT
GATTTCGCGACGGTGCGCAAGGTACTGAGCATGCCTCAAGTCAATATTGTTAAGAAAACCGAAGTGCAGACGGGCGG
GTTTTCCAAGGAAAGCATCTTACCCAAACGTAATTCAGATAAACTTATTGCACGCAAAAAGGACTGGGATCCGAAAA
AGTATGGAGGCTTCGACAGTCCAACCGTAGCCTACTCTGTTCTCGTTGTAGCGAAAGTAGAAAAGGGTAAATCCAAG
```

```
AAACTGAAATCTGTCAAGGAGTTGCTTGGAATCACCATTATGGAGCGTAGCTCCTTCGAGAAGAACCCGATTGACTT
TCTGGAAGCCAAAGGATATAAAGAGGTCAAGAAAGATCTTATCATTAAGCTGCCTAAGTATTCACTCTTCGAGCTGG
AAAATGGTCGTAAACGCATGCTCGCTTCTGCCGGCGAGTTGCAGAAGGGCAATGAATTAGCACTTCCATCAAAGTAC
GTTAACTTCCTGTATTTGGCCAGCCATTACGAGAAACTGAAGGGGTCTCCAGAGGACAACGAACAGAAACAATTATT
TGTAGAGCAGCACAAGCATTATCTTGATGAAATCATTGAGCAAATTTCCGAATTCAGTAAACGCGTAATCCTGGCCG
ATGCAAACCTCGACAAGGTGCTGAGCGCTTACAATAAGCATCGCGACAAACCTATCCGTGAGCAGGCTGAAAATATC
ATTCACCTGTTCACATTAACGAACCTGGGCGCTCCGGCCGCTTTTAAATATTTCGACACGACAATCGACCGTAAGCG
CTATACCAGTACGAAAGAAGTGTTGGATGCGACCCTTATTCACCAGTCAATTACAGGATTATATGAGACCCGTATCG
ACCTTAGCCAATTAGGTGGGGATGCGCCCGCTCCTGCGCCAGCTCCTGCACCTGCGATGGTTAGCAAAGGTGAAGAA
CTGTTTACCGGCGTTGTGCCGATTCTGGTGGAACTGGATGGTGATGTGAATGGCCATAAATTTAGCGTTagcGGCGA
AGGCGAAGGTGATGCGACCtatGGTAAACTGACCCTGAAATTTATTTGCACCACCGGTAAACTGCCGGTTCCGTGGC
CGACCCTGGTGACCACCCTGACCTATGGCGTTCAGTGCTTTAGCCGCTATCCGGATCATATGAAAcagCATGATTTC
TTTAAAAGCGCGATGCCGGAAGGCTATGTGCAGGAACGTACCATTtttTTCAAAGATGATGGCaacTATAAAACCCG
TGCGGAAGTTAAATTTGAAGGCGATACCCTGGTGAACCGCATTGAACTGAAAGGTATTGATTTTAAAGAAGATGGCA
ACATTCTGGGTCATAAACTGGAATATAATtacAACAGCCATAATGTGTATATTatgGCCGATAAACAGAAAAATGGC
ATCAAAgtgAACTTTAAAATCCGTCACAACattGAAGATGGTAGCGTGCAGCTGGCGGATCATTATCAGCAGAATAC
CCCGATTGGTGATGGCCCGGTGCTGCTGCCGGATAATCATTATCTGAGCACCCAGAGCgcgCTGAGCAAAGATCCGA
ATGAAAAACGTGATCATATGGTGCTGCTGGAATTTGTTACCGCCGCGGGCATTACCctgGGTATGGATGAACTGTAT
AAA
```
(Cas9-APAPAPAPAPAPA-eGFP chimera DNA sequence)

SEQ ID NO: 359
```
ATGGACAAAAAGTACTCTATTGGCCTGGATATCGGGACCAACAGCGTCGGGTGGCTGTTATCACCGACGAGTATAA
AGTACCTTCGAAAAAGTTCAAAGTGCTGGGCAACACCGATCGCCATTCAATCAAAAAGAACTTGATTGGTGCGCTGT
TGTTTGACTCCGGGGAAACCGCCGAGGCGACTCGCCTTAAACGTACAGCACGTCGCCGGTACACTCGGCGTAAGAAT
CGCATTTGCTATTTGCAGGAAATCTTTAGCAACGAGATGGCAAAGTCGATGACTCGTTTTTCCACCGCCTCGAGGA
AAGCTTTCTGGTGGAGGAAGACAAAAAGCATGAGCGTCACCCGATCTTCGGCAACATTGTCGATGAAGTAGCGTATC
ATGAAAAATACCCAACCATTTACCACTTACGCAAAAAGCTGGTGGACAGCACTGACAAAGCTGATTTGCGCCTTATC
TATTTAGCCCTGGCACATATGATTAAGTTTCGTGGTCACTTCCTGATCGAAGGAGACTTAAATCCCGACAACAGTGA
TGTTGATAAATTGTTTATTCAGCTTGTCCAAACTTACAATCAACTGTTCGAGGAAAACCCGATCAATGCCTCCGGTG
TGGATGCAAAAGCCATTTTAAGTGCACGCCTTAGCAAGTCCCGTCGCTTAGAAAACCTTATCGCGCAGCTGCCCGGC
GAGAAAAAGAATGGTTTGTTTGGGAACCTTATTGCCTTGAGCTTAGGCCTCACCCCGAATTTCAAAAGTAATTTCGA
TCTTGCAGAAGACGCCAAATTACAACTGTCGAAGGATACTTATGATGACGATCTCGATAATCTGTTAGCGCAGATTG
GTGACCAATACGCCGATCTTTTTCTGGCGGCTAAAAATCTGAGCGACGCCATCTTGCTTTCGGATATTCTCCGCGTT
AACACCGAAATCACGAAAGCGCCTCTTAGTGCCAGCATGATTAAACGTTATGATGAACACCACCAGGACCTGACCTT
ACTCAAAGCGTTGGTTCGCCAGCAACTGCCAGAGAAGTACAAAGAAATCTTCTTTGATCAGTCAAAGAATGGTTATG
CCGGCTATATTGACGGGGGTGCAAGCCAAGAGGAATTCTACAAATTTATCAAGCCTATTCTGGAGAAAATGGATGGC
ACCGAAGAGTTATTGGTGAAGCTTAACCGTGAAGACCTCCTGCGGAAACAGCGCACATTCGATAATGGTTCGATCCC
ACACCAAATCCATTTGGGGGAGTTACACGCTATTTTGCGTCGCCAGGAAGACTTTTACCCTTTCCTGAAGGATAACC
GGGAGAAAATTGAGAAGATCCTTACCTTTCGTATTCCGTATTACGTAGGCCCCTTAGCACGGGGTAATAGCCGTTTC
GCGTGGATGACACGGAAGTCGGAAGAGACGATCACCCCGTGGAACTTCGAAGAGGTAGTCGACAAGGGCGCATCAGC
GCAGTCTTTTATTGAACGTATGACGAATTTCGATAAAAACTTGCCCAATGAGAAGGTGCTTCCGAAACATTCCTTGT
```

-continued

```
TATATGAATATTTTACAGTTTACAACGAGCTGACCAAGGTTAAATACGTGACGGAAGGAATGCGCAAGCCCGCTTTT
CTTAGCGGTGAGCAAAAAAGGCGATCGTCGACCTGTTATTCAAAACGAATCGTAAGGTGACTGTAAAGCAACTCAA
AGAAGATTACTTCAAAAAGATTGAGTGCTTCGACAGCGTCGAAATCTCTGGGGTAGAGGATCGGTTTAACGCAAGTT
TAGGTACCTACCATGACCTGCTTAAAATCATTAAGGATAAAGACTTCTTAGATAATGAAGAGAACGAAGATATTCTC
GAGGACATCGTCTTGACGTTAACCTTATTTGAGGATCGTGAAATGATTGAGGAACGCCTCAAAACTTATGCCCACCT
GTTCGACGATAAGGTGATGAAGCAGCTGAAACGTCGGCGCTACACAGGATGGGGCCGCTTGAGTCGCAAACTTATTA
ACGGAATCCGTGACAAGCAATCCGGCAAAACGATTCTGGATTTCTTGAAGTCGGACGGATTTGCTAATCGCAACTTC
ATGCAGTTGATCCATGATGACTCCCTGACTTTTAAAGAGGATATTCAAAAGGCGCAGGTTAGTGGTCAAGGCGACAG
CTTACACGAACACATCGCAAATTTGGCTGGTTCGCCGGCCATTAAAAAGGGGATCCTCCAGACCGTGAAAGTTGTAG
ATGAGCTTGTTAAGGTCATGGGTCGTCATAAGCCCGAAAACATCGTGATTGAAATGGCGCGGGAGAATCAAACGACC
CAGAAAGGACAAAAGAATAGCCGTGAACGGATGAAGCGGATCGAGGAAGGCATTAAAGAGCTGGGGTCTCAAATCTT
GAAGGAACACCCTGTGGAGAACACTCAGCTCCAAAATGAAAAACTTTACCTGTACTATTTGCAGAACGGACGCGATA
TGTACGTGGACCAAGAGTTGGATATTAATCGGCTGAGTGACTACGACGTTGATCATATCGTCCCGCAGAGCTTCCTC
AAAGACGATTCTATTGACAATAAGGTACTGACGCGCTCTGATAAAAACCGTGGTAAGTCGGACAACGTGCCCTCCGA
AGAGGTTGTGAAAAAGATGAAAAATTATTGGCGCCAGCTTTTAAACGCGAAGCTGATCACACAACGTAAATTCGATA
ATTTGACCAAGGCTGAACGGGGTGGCCTGAGCGAGTTAGATAAGGCAGGATTTATTAAACGCCAGTTAGTGGAGACT
CGTCAAATCACCAAACATGTCGCGCAGATTTTGGACAGCCGGATGAACACCAAGTACGATGAAAATGACAAACTGAT
CCGTGAGGTGAAAGTCATTACTCTGAAGTCCAAATTAGTTAGTGATTTCCGGAAGGACTTTCAATTCTACAAAGTCC
GTGAAATTAATAACTATCATCACGCACATGACGCGTACCTGAATGCAGTGGTTGGGACCGCCCTTATCAAGAAATAT
CCTAAGCTGGAGTCGGAGTTTGTCTATGGCGACTATAAGGTATACGATGTTCGCAAAATGATTGCGAAATCTGAGCA
GGAGATCGGTAAGGCAACCGCAAAATATTTCTTTTACTCAAACATTATGAATTTCTTTAAGACAGAAATCACTCTGG
CCAACGGGGAGATTCGCAAACGTCCGTTGATCGAAACAAACGGCGAGACTGGCGAAATTGTTTGGGACAAAGGGCGT
GATTTCGCGACGGTGCGCAAGGTACTGAGCATGCCTCAAGTCAATATTGTTAAGAAAACCGAAGTGCAGACGGGCGG
GTTTTCCAAGGAAAGCATCTTACCCAAACGTAATTCAGATAAACTTATTGCACGCAAAAAGGACTGGGATCCGAAAA
AGTATGGAGGCTTCGACAGTCCAACCGTAGCCTACTCTGTTCTCGTTGTAGCGAAAGTAGAAAAGGGTAAATCCAAG
AAACTGAAATCTGTCAAGGAGTTGCTTGGAATCACCATTATGGAGCGTAGCTCCTTCGAGAAGAACCCGATTGACTT
TCTGGAAGCCAAAGGATATAAAGAGGTCAAGAAAGATCTTATCATTAAGCTGCCTAAGTATTCACTCTTCGAGCTGG
AAAATGGTCGTAAACGCATGCTCGCTTCTGCCGGCGAGTTGCAGAAGGGCAATGAATTAGCACTTCCATCAAAGTAC
GTTAACTTCCTGTATTTGGCCAGCCATTACGAGAAACTGAAGGGGTCTCCAGAGGACAACGAACAGAAACAATTATT
TGTAGAGCAGCACAAGCATTATCTTGATGAAATCATTGAGCAAATTTCCGAATTCAGTAAACGCGTAATCCTGGCCG
ATGCAAACCTCGACAAGGTGCTGAGCGCTTACAATAAGCATCGCGACAAACCTATCCGTGAGCAGGCTGAAAATATC
ATTCACCTGTTCACATTAACGAACCTGGGCGCTCCGGCCGCTTTTAAATATTTCGACACGACAATCGACCGTAAGCG
CTATACCAGTACGAAAGAAGTGTTGGATGCGACCCTTATTCACCAGTCAATTACAGGATTATATGAGACCCGTATCG
ACCTTAGCCAATTAGGTGGGGATGCGCCAGCGCCTGCTCCTGCACCCGCTCCAGCACCTGCGATGGTTAGCAAAGGT
GAAGAACTGTTTACCGGCGTTGTGCCGATTCTGGTGGAACTGGATGGTGATGTGAATGGCCATAAATTTAGCGTTag
cGGCGAAGGCGAAGGTGATGCGACCtatGGTAAACTGACCCTGAAATTTATTTGCACCACCGGTAAACTGCCGGTTC
CGTGGCCGACCCTGGTGACCACCCTGACCTATGGCGTTCAGTGCTTTAGCCGCTATCCGGATCATATGAAAcagCAT
GATTTCTTTAAAAGCGCGATGCCGGAAGGCTATGTGCAGGAACGTACCATTtttTTCAAAGATGATGGCaacTATAA
AACCCGTGCGGAAGTTAAATTTGAAGGCGATACCCTGGTGAACCGCATTGAACTGAAAGGTATTGATTTTAAAGAAG
ATGGCAACATTCTGGGTCATAAACTGGAATATAATtacAACAGCCATAATGTGTATATTatgGCCGATAAACAGAAA
AATGGCATCAAAgtgAACTTTAAAATCCGTCACAACattGAAGATGGTAGCGTGCAGCTGGCGGATCATTATCAGCA
```

GAATACCCCGATTGGTGATGGCCCGGTGCTGCTGCCGGATAATCATTATCTGAGCACCCAGAGCgcgCTGAGCAAAG

ATCCGAATGAAAAACGTGATCATATGGTGCTGCTGGAATTTGTTACCGCCGCGGGCATTACCctgGGTATGGATGAA

CTGTATAAA (Cas9-APAPAPAPAPAPAPA-eGFP chimera DNA sequence)

SEQ ID NO: 360

ATGGACAAAAAGTACTCTATTGGCCTGGATATCGGGACCAACAGCGTCGGGTGGGCTGTTATCACCGACGAGTATAA

AGTACCTTCGAAAAAGTTCAAAGTGCTGGGCAACACCGATCGCCATTCAATCAAAAAGAACTTGATTGGTGCGCTGT

TGTTTGACTCCGGGGAAACCGCCGAGGCGACTCGCCTTAAACGTACAGCACGTCGCCGGTACACTCGGCGTAAGAAT

CGCATTTGCTATTTGCAGGAAATCTTTAGCAACGAGATGGCAAAAGTCGATGACTCGTTTTTCCACCGCCTCGAGGA

AAGCTTTCTGGTGGAGGAAGACAAAAAGCATGAGCGTCACCCGATCTTCGGCAACATTGTCGATGAAGTAGCGTATC

ATGAAAAATACCCAACCATTTACCACTTACGCAAAAAGCTGGTGGACAGCACTGACAAAGCTGATTTGCGCCTTATC

TATTTAGCCCTGGCACATATGATTAAGTTTCGTGGTCACTTCCTGATCGAAGGAGACTTAAATCCCGACAACAGTGA

TGTTGATAAATTGTTTATTCAGCTTGTCCAAACTTACAATCAACTGTTCGAGGAAAACCCGATCAATGCCTCCGGTG

TGGATGCAAAAGCCATTTTAAGTGCACGCCTTAGCAAGTCCCGTCGCTTAGAAAACCTTATCGCGCAGCTGCCCGGC

GAGAAAAAGAATGGTTTGTTTGGGAACCTTATTGCCTTGAGCTTAGGCCTCACCCCGAATTTCAAAAGTAATTTCGA

TCTTGCAGAAGACGCCAAATTACAACTGTCGAAGGATACTTATGATGACGATCTCGATAATCTGTTAGCGCAGATTG

GTGACCAATACGCCGATCTTTTTCTGGCGGCTAAAAATCTGAGCGACGCCATCTTGCTTTCGGATATTCTCCGCGTT

AACACCGAAATCACGAAAGCGCCTCTTAGTGCCAGCATGATTAAACGTTATGATGAACACCACCAGGACCTGACCTT

ACTCAAAGCGTTGGTTCGCCAGCAACTGCCAGAGAAGTACAAAGAAATCTTCTTTGATCAGTCAAAGAATGGTTATG

CCGGCTATATTGACGGGGGTGCAAGCCAAGAGGAATTCTACAAATTTATCAAGCCTATTCTGGAGAAAATGGATGGC

ACCGAAGAGTTATTGGTGAAGCTTAACCGTGAAGACCTCCTGCGGAAACAGCGCACATTCGATAATGGTTCGATCCC

ACACCAAATCCATTTGGGGGAGTTACACGCTATTTTGCGTCGCCAGGAAGACTTTTACCCTTTCCTGAAGGATAACC

GGGAGAAAATTGAGAAGATCCTTACCTTTCGTATTCCGTATTACGTAGGCCCCTTAGCACGGGGTAATAGCCGTTTC

GCGTGGATGACACGGAAGTCGGAAGAGACGATCACCCCGTGGAACTTCGAAGAGGTAGTCGACAAGGGCGCATCAGC

GCAGTCTTTTATTGAACGTATGACGAATTTCGATAAAAACTTGCCCAATGAGAAGGTGCTTCCGAAACATTCCTTGT

TATATGAATATTTTACAGTTTACAACGAGCTGACCAAGGTTAAATACGTGACGGAAGGAATGCGCAAGCCCGCTTTT

CTTAGCGGTGAGCAAAAAAAGGCGATCGTCGACCTGTTATTCAAAACGAATCGTAAGGTGACTGTAAAGCAACTCAA

AGAAGATTACTTCAAAAAGATTGAGTGCTTCGACAGCGTCGAAATCTCTGGGGTAGAGGATCGGTTTAACGCAAGTT

TAGGTACCTACCATGACCTGCTTAAAATCATTAAGGATAAAGACTTCTTAGATAATGAAGAGAACGAAGATATTCTC

GAGGACATCGTCTTGACGTTAACCTTATTTGAGGATCGTGAAATGATTGAGGAACGCCTCAAAACTTATGCCCACCT

GTTCGACGATAAGGTGATGAAGCAGCTGAAACGTCGGCGCTACACAGGATGGGGCCGCTTGAGTCGCAAACTTATTA

ACGGAATCCGTGACAAGCAATCCGGCAAAACGATTCTGGATTTCTTGAAGTCGGACGGATTTGCTAATCGCAACTTC

ATGCAGTTGATCCATGATGACTCCCTGACTTTTAAAGAGGATATTCAAAAGGCGCAGGTTAGTGGTCAAGGCGACAG

CTTACACGAACACATCGCAAATTTGGCTGGTTCGCCGGCCATTAAAAAGGGGATCCTCCAGACCGTGAAAGTTGTAG

ATGAGCTTGTTAAGGTCATGGGTCGTCATAAGCCCGAAAACATCGTGATTGAAATGGCGCGGGAGAATCAAACGACC

CAGAAAGGACAAAAGAATAGCCGTGAACGGATGAAGCGGATCGAGGAAGGCATTAAAGAGCTGGGGTCTCAAATCTT

GAAGGAACACCCTGTGGAGAACACTCAGCTCCAAAATGAAAAACTTTACCTGTACTATTTGCAGAACGGACGCGATA

TGTACGTGGACCAAGAGTTGGATATTAATCGGCTGAGTGACTACGACGTTGATCATATCGTCCCGCAGAGCTTCCTC

AAAGACGATTCTATTGACAATAAGGTACTGACGCGCTCTGATAAAAACCGTGGTAAGTCGGACAACGTGCCCTCCGA

AGAGGTTGTGAAAAAGATGAAAAATTATTGGCGCCAGCTTTTAAACGCGAAGCTGATCACACAACGTAAATTCGATA

ATTTGACCAAGGCTGAACGGGGTGGCCTGAGCGAGTTAGATAAGGCAGGATTTATTAAACGCCAGTTAGTGGAGACT

-continued

CGTCAAATCACCAAACATGTCGCGCAGATTTTGGACAGCCGGATGAACACCAAGTACGATGAAAATGACAAACTGAT

CCGTGAGGTGAAAGTCATTACTCTGAAGTCCAAATTAGTTAGTGATTTCCGGAAGGACTTTCAATTCTACAAAGTCC

GTGAAATTAATAACTATCATCACGCACATGACGCGTACCTGAATGCAGTGGTTGGGACCGCCCTTATCAAGAAATAT

CCTAAGCTGGAGTCGGAGTTTGTCTATGGCGACTATAAGGTATACGATGTTCGCAAAATGATTGCGAAATCTGAGCA

GGAGATCGGTAAGGCAACCGCAAAATATTTCTTTTACTCAAACATTATGAATTTCTTTAAGACAGAAATCACTCTGG

CCAACGGGAGATTCGCAAACGTCCGTTGATCGAAACAAACGGCGAGACTGGCGAAATTGTTTGGGACAAAGGGCGT

GATTTCGCGACGGTGCGCAAGGTACTGAGCATGCCTCAAGTCAATATTGTTAAGAAAACCGAAGTGCAGACGGGCGG

GTTTTCCAAGGAAAGCATCTTACCCAAACGTAATTCAGATAAACTTATTGCACGCAAAAAGGACTGGGATCCGAAAA

AGTATGGAGGCTTCGACAGTCCAACCGTAGCCTACTCTGTTCTCGTTGTAGCGAAAGTAGAAAAGGGTAAATCCAAG

AAACTGAAATCTGTCAAGGAGTTGCTTGGAATCACCATTATGGAGCGTAGCTCCTTCGAGAAGAACCCGATTGACTT

TCTGGAAGCCAAAGGATATAAAGAGGTCAAGAAAGATCTTATCATTAAGCTGCCTAAGTATTCACTCTTCGAGCTGG

AAAATGGTCGTAAACGCATGCTCGCTTCTGCCGGCGAGTTGCAGAAGGGCAATGAATTAGCACTTCCATCAAAGTAC

GTTAACTTCCTGTATTTGGCCAGCCATTACGAGAAACTGAAGGGGTCTCCAGAGGACAACGAACAGAAACAATTATT

TGTAGAGCAGCACAAGCATTATCTTGATGAAATCATTGAGCAAATTTCCGAATTCAGTAAACGCGTAATCCTGGCCG

ATGCAAACCTCGACAAGGTGCTGAGCGCTTACAATAAGCATCGCGACAAACCTATCCGTGAGCAGGCTGAAAATATC

ATTCACCTGTTCACATTAACGAACCTGGGCGCTCCGGCCGCTTTTAAATATTTCGACACGACAATCGACCGTAAGCG

CTATACCAGTACGAAAGAAGTGTTGGATGCGACCCTTATTCACCAGTCAATTACAGGATTATATGAGACCCGTATCG

ACCTTAGCCAATTAGGTGGGGATGCGCCAGCGCCTGCTCCTGCACCCGCTCCAGCTCCTGCCCCAGCGATGGTTAGC

AAAGGTGAAGAACTGTTTACCGGCGTTGTGCCGATTCTGGTGGAACTGGATGGTGATGTGAATGGCCATAAATTTAG

CGTTagcGGCGAAGGCGAAGGTGATGCGACCtatGGTAAACTGACCCTGAAATTTATTTGCACCACCGGTAAACTGC

CGGTTCCGTGGCCGACCCTGGTGACCACCCTGACCTATGGCGTTCAGTGCTTTAGCCGCTATCCGGATCATATGAAA cagCATGATTTCTTTAAAAGCGCGATGCCGGAAGGCTATGTGCAGGAACGTACCATTtttTTCAAAGATGATGGCaa cTATAAAACCCGTGCGGAAGTTAAATTTGAAGGCGATACCCTGGTGAACCGCATTGAACTGAAAGGTATTGATTTTA AAGAAGATGGCAACATTCTGGGTCATAAACTGGAATATAATtacAACAGCCATAATGTGTATATTatgGCCGATAAA CAGAAAAATGGCATCAAAgtgAACTTTAAAATCCGTCACAACattGAAGATGGTAGCGTGCAGCTGGCGGATCATTA TCAGCAGAATACCCCGATTGGTGATGGCCCGGTGCTGCTGCCGGATAATCATTATCTGAGCACCCAGAGCgcgCTGA GCAAAGATCCGAATGAAAAACGTGATCATATGGTGCTGCTGGAATTTGTTACCGCCGCGGGCATTACCctgGGTATG

GATGAACTGTATAAA (Cas9-APAPAPAPAPAPAPAPAPA-eGFP chimera DNA sequence)

SEQ ID NO: 361

ATGGACAAAAAGTACTCTATTGGCCTGGATATCGGGACCAACAGCGTCGGGTGGGCTGTTATCACCGACGAGTATAA

AGTACCTTCGAAAAAGTTCAAAGTGCTGGGCAACACCGATCGCCATTCAATCAAAAAGAACTTGATTGGTGCGCTGT

TGTTTGACTCCGGGGAAACCGCCGAGGCGACTCGCCTTAAACGTACAGCACGTCGCCGGTACACTCGGCGTAAGAAT

CGCATTTGCTATTTGCAGGAAATCTTTAGCAACGAGATGGCAAAAGTCGATGACTCGTTTTTCCACCGCCTCGAGGA

AAGCTTTCTGGTGGAGGAAGACAAAAAGCATGAGCGTCACCCGATCTTCGGCAACATTGTCGATGAAGTAGCGTATC

ATGAAAAATACCCAACCATTTACCACTTACGCAAAAAGCTGGTGGACAGCACTGACAAAGCTGATTTGCGCCTTATC

TATTTAGCCCTGGCACATATGATTAAGTTTCGTGGTCACTTCCTGATCGAAGGAGACTTAAATCCCGACAACAGTGA

TGTTGATAAATTGTTTATTCAGCTTGTCCAAACTTACAATCAACTGTTCGAGGAAAACCCGATCAATGCCTCCGGTG

TGGATGCAAAAGCCATTTTAAGTGCACGCCTTAGCAAGTCCCGTCGCTTAGAAAACCTTATCGCGCAGCTGCCCGGC

GAGAAAAAGAATGGTTTGTTTGGGAACCTTATTGCCTTGAGCTTAGGCCTCACCCCGAATTTCAAAAGTAATTTCGA

TCTTGCAGAAGACGCCAAATTACAACTGTCGAAGGATACTTATGATGACGATCTCGATAATCTGTTAGCGCAGATTG

GTGACCAATACGCCGATCTTTTTCTGGCGGCTAAAAATCTGAGCGACGCCATCTTGCTTTCGGATATTCTCCGCGTT

-continued

```
AACACCGAAATCACGAAAGCGCCTCTTAGTGCCAGCATGATTAAACGTTATGATGAACACCACCAGGACCTGACCTT
ACTCAAAGCGTTGGTTCGCCAGCAACTGCCAGAGAAGTACAAAGAAATCTTCTTTGATCAGTCAAAGAATGGTTATG
CCGGCTATATTGACGGGGGTGCAAGCCAAGAGGAATTCTACAAATTTATCAAGCCTATTCTGGAGAAAATGGATGGC
ACCGAAGAGTTATTGGTGAAGCTTAACCGTGAAGACCTCCTGCGGAAACAGCGCACATTCGATAATGGTTCGATCCC
ACACCAAATCCATTTGGGGGAGTTACACGCTATTTTGCGTCGCCAGGAAGACTTTTACCCTTTCCTGAAGGATAACC
GGGAGAAAATTGAGAAGATCCTTACCTTTCGTATTCCGTATTACGTAGGCCCCTTAGCACGGGGTAATAGCCGTTTC
GCGTGGATGACACGGAAGTCGGAAGAGACGATCACCCCGTGGAACTTCGAAGAGGTAGTCGACAAGGGCGCATCAGC
GCAGTCTTTTATTGAACGTATGACGAATTTCGATAAAAACTTGCCCAATGAGAAGGTGCTTCCGAAACATTCCTTGT
TATATGAATATTTTACAGTTTACAACGAGCTGACCAAGGTTAAATACGTGACGGAAGGAATGCGCAAGCCCGCTTTT
CTTAGCGGTGAGCAAAAAAGGCGATCGTCGACCTGTTATTCAAAACGAATCGTAAGGTGACTGTAAAGCAACTCAA
AGAAGATTACTTCAAAAAGATTGAGTGCTTCGACAGCGTCGAAATCTCTGGGGTAGAGGATCGGTTTAACGCAAGTT
TAGGTACCTACCATGACCTGCTTAAAATCATTAAGGATAAAGACTTCTTAGATAATGAAGAGAACGAAGATATTCTC
GAGGACATCGTCTTGACGTTAACCTTATTTGAGGATCGTGAAATGATTGAGGAACGCCTCAAAACTTATGCCCACCT
GTTCGACGATAAGGTGATGAAGCAGCTGAAACGTCGGCGCTACACAGGATGGGGCCGCTTGAGTCGCAAACTTATTA
ACGGAATCCGTGACAAGCAATCCGGCAAAACGATTCTGGATTTCTTGAAGTCGGACGGATTTGCTAATCGCAACTTC
ATGCAGTTGATCCATGATGACTCCCTGACTTTTAAAGAGGATATTCAAAAGGCGCAGGTTAGTGGTCAAGGCGACAG
CTTACACGAACACATCGCAAATTTGGCTGGTTCGCCGGCCATTAAAAAGGGGATCCTCCAGACCGTGAAAGTTGTAG
ATGAGCTTGTTAAGGTCATGGGTCGTCATAAGCCCGAAAACATCGTGATTGAAATGGCGCGGGAGAATCAAACGACC
CAGAAAGGACAAAAGAATAGCCGTGAACGGATGAAGCGGATCGAGGAAGGCATTAAAGAGCTGGGGTCTCAAATCTT
GAAGGAACACCCTGTGGAGAACACTCAGCTCCAAAATGAAAAACTTTACCTGTACTATTTGCAGAACGGACGCGATA
TGTACGTGGACCAAGAGTTGGATATTAATCGGCTGAGTGACTACGACGTTGATCATATCGTCCCGCAGAGCTTCCTC
AAAGACGATTCTATTGACAATAAGGTACTGACGCGCTCTGATAAAAACCGTGGTAAGTCGGACAACGTGCCCTCCGA
AGAGGTTGTGAAAAAGATGAAAAATTATTGGCGCCAGCTTTTAAACGCGAAGCTGATCACACAACGTAAATTCGATA
ATTTGACCAAGGCTGAACGGGGTGGCCTGAGCGAGTTAGATAAGGCAGGATTTATTAAACGCCAGTTAGTGGAGACT
CGTCAAATCACCAAACATGTCGCGCAGATTTTGGACAGCCGGATGAACACCAAGTACGATGAAAATGACAAACTGAT
CCGTGAGGTGAAAGTCATTACTCTGAAGTCCAAATTAGTTAGTGATTTCCGGAAGGACTTTCAATTCTACAAAGTCC
GTGAAATTAATAACTATCATCACGCACATGACGCGTACCTGAATGCAGTGGTTGGGACCGCCCTTATCAAGAAATAT
CCTAAGCTGGAGTCGGAGTTTGTCTATGGCGACTATAAGGTATACGATGTTCGCAAAATGATTGCGAAATCTGAGCA
GGAGATCGGTAAGGCAACCGCAAAATATTTCTTTTACTCAAACATTATGAATTTCTTTAAGACAGAAATCACTCTGG
CCAACGGGGAGATTCGCAAACGTCCGTTGATCGAAACAAACGGCGAGACTGGCGAAATTGTTTGGGACAAAGGGCGT
GATTTCGCGACGGTGCGCAAGGTACTGAGCATGCCTCAAGTCAATATTGTTAAGAAAACCGAAGTGCAGACGGGCGG
GTTTTCCAAGGAAAGCATCTTACCCAAACGTAATTCAGATAAACTTATTGCACGCAAAAAGGACTGGGATCCGAAAA
AGTATGGAGGCTTCGACAGTCCAACCGTAGCCTACTCTGTTCTCGTTGTAGCGAAAGTAGAAAAGGGTAAATCCAAG
AAACTGAAATCTGTCAAGGAGTTGCTTGGAATCACCATTATGGAGCGTAGCTCCTTCGAGAAGAACCCGATTGACTT
TCTGGAAGCCAAAGGATATAAAGAGGTCAAGAAAGATCTTATCATTAAGCTGCCTAAGTATTCACTCTTCGAGCTGG
AAAATGGTCGTAAACGCATGCTCGCTTCTGCCGGCGAGTTGCAGAAGGGCAATGAATTAGCACTTCCATCAAAGTAC
GTTAACTTCCTGTATTTGGCCAGCCATTACGAGAAACTGAAGGGGTCTCCAGAGGACAACGAACAGAAACAATTATT
TGTAGAGCAGCACAAGCATTATCTTGATGAAATCATTGAGCAAATTTCCGAATTCAGTAAACGCGTAATCCTGGCCG
ATGCAAACCTCGACAAGGTGCTGAGCGCTTACAATAAGCATCGCGACAAACCTATCCGTGAGCAGGCTGAAAATATC
ATTCACCTGTTCACATTAACGAACCTGGGCGCTCCGGCCGCTTTTAAATATTTCGACACGACAATCGACCGTAAGCG
```

-continued

CTATACCAGTACGAAAGAAGTGTTGGATGCGACCCTTATTCACCAGTCAATTACAGGATTATATGAGACCCGTATCG

ACCTTAGCCAATTAGGTGGGGATGCGCCAGCGCCTGCTCCTGCACCCGCTCCAGCGCCAGCTCCTGCACCTGCGATG

GTTAGCAAAGGTGAAGAACTGTTTACCGGCGTTGTGCCGATTCTGGTGGAACTGGATGGTGATGTGAATGGCCATAA

ATTTAGCGTTagcGGCGAAGGCGAAGGTGATGCGACCtatGGTAAACTGACCCTGAAATTTATTTGCACCACCGGTA

AACTGCCGGTTCCGTGGCCGACCCTGGTGACCACCCTGACCTATGGCGTTCAGTGCTTTAGCCGCTATCCGGATCAT

ATGAAAcagCATGATTTCTTTAAAAGCGCGATGCCGGAAGGCTATGTGCAGGAACGTACCATTtttTTCAAAGATGA

TGGCaacTATAAAACCCGTGCGGAAGTTAAATTTGAAGGCGATACCCTGGTGAACCGCATTGAACTGAAAGGTATTG

ATTTTAAAGAAGATGGCAACATTCTGGGTCATAAACTGGAATATAATtacAACAGCCATAATGTGTATATTatgGCC

GATAAACAGAAAAATGGCATCAAAgtgAACTTTAAAATCCGTCACAACattGAAGATGGTAGCGTGCAGCTGGCGGA

TCATTATCAGCAGAATACCCCGATTGGTGATGGCCCGGTGCTGCTGCCGGATAATCATTATCTGAGCACCCAGAGCg cgCTGAGCAAAGATCCGAATGAAAAACGTGATCATATGGTGCTGCTGGAATTTGTTACCGCCGCGGGCATTACCctg

GGTATGGATGAACTGTATAAA (Cas9-APAPAPAPAPAPAPAPAPAPAPA-eGFP chimera DNA sequence)

SEQ ID NO: 362

ATGGACAAAAAGTACTCTATTGGCCTGGATATCGGGACCAACAGCGTCGGGTGGGCTGTTATCACCGACGAGTATAA

AGTACCTTCGAAAAAGTTCAAAGTGCTGGGCAACACCGATCGCCATTCAATCAAAAAGAACTTGATTGGTGCGCTGT

TGTTTGACTCCGGGGAAACCGCCGAGGCGACTCGCCTTAAACGTACAGCACGTCGCCGGTACACTCGGCGTAAGAAT

CGCATTTGCTATTTGCAGGAAATCTTTAGCAACGAGATGGCAAAAGTCGATGACTCGTTTTTCCACCGCCTCGAGGA

AAGCTTTCTGGTGGAGGAAGACAAAAAGCATGAGCGTCACCCGATCTTCGGCAACATTGTCGATGAAGTAGCGTATC

ATGAAAAATACCCAACCATTTACCACTTACGCAAAAAGCTGGTGGACAGCACTGACAAAGCTGATTTGCGCCTTATC

TATTTAGCCCTGGCACATATGATTAAGTTTCGTGGTCACTTCCTGATCGAAGGAGACTTAAATCCCGACAACAGTGA

TGTTGATAAATTGTTTATTCAGCTTGTCCAAACTTACAATCAACTGTTCGAGGAAAACCCGATCAATGCCTCCGGTG

TGGATGCAAAAGCCATTTTAAGTGCACGCCTTAGCAAGTCCCGTCGCTTAGAAAACCTTATCGCGCAGCTGCCCGGC

GAGAAAAAGAATGGTTTGTTTGGGAACCTTATTGCCTTGAGCTTAGGCCTCACCCCGAATTTCAAAAGTAATTTCGA

TCTTGCAGAAGACGCCAAATTACAACTGTCGAAGGATACTTATGATGACGATCTCGATAATCTGTTAGCGCAGATTG

GTGACCAATACGCCGATCTTTTTCTGGCGGCTAAAAATCTGAGCGACGCCATCTTGCTTTCGGATATTCTCCGCGTT

AACACCGAAATCACGAAAGCGCCTCTTAGTGCCAGCATGATTAAACGTTATGATGAACACCACCAGGACCTGACCTT

ACTCAAAGCGTTGGTTCGCCAGCAACTGCCAGAGAAGTACAAAGAAATCTTCTTTGATCAGTCAAAGAATGGTTATG

CCGGCTATATTGACGGGGGTGCAAGCCAAGAGGAATTCTACAAATTTATCAAGCCTATTCTGGAGAAAATGGATGGC

ACCGAAGAGTTATTGGTGAAGCTTAACCGTGAAGACCTCCTGCGGAAACAGCGCACATTCGATAATGGTTCGATCCC

ACACCAAATCCATTTGGGGGAGTTACACGCTATTTTGCGTCGCCAGGAAGACTTTTACCCTTTCCTGAAGGATAACC

GGGAGAAAATTGAGAAGATCCTTACCTTTCGTATTCCGTATTACGTAGGCCCCTTAGCACGGGGTAATAGCCGTTTC

GCGTGGATGACACGGAAGTCGGAAGAGACGATCACCCCGTGGAACTTCGAAGAGGTAGTCGACAAGGGCGCATCAGC

GCAGTCTTTTATTGAACGTATGACGAATTTCGATAAAAACTTGCCCAATGAGAAGGTGCTTCCGAAACATTCCTTGT

TATATGAATATTTTACAGTTTACAACGAGCTGACCAAGGTTAAATACGTGACGGAAGGAATGCGCAAGCCCGCTTTT

CTTAGCGGTGAGCAAAAAAGGCGATCGTCGACCTGTTATTCAAAACGAATCGTAAGGTGACTGTAAAGCAACTCAA

AGAAGATTACTTCAAAAAGATTGAGTGCTTCGACAGCGTCGAAATCTCTGGGGTAGAGGATCGGTTTAACGCAAGTT

TAGGTACCTACCATGACCTGCTTAAAATCATTAAGGATAAAGACTTCTTAGATAATGAAGAGAACGAAGATATTCTC

GAGGACATCGTCTTGACGTTAACCTTATTTGAGGATCGTGAAATGATTGAGGAACGCCTCAAAACTTATGCCCACCT

GTTCGACGATAAGGTGATGAAGCAGCTGAAACGTCGGCGCTACACAGGATGGGGCCGCTTGAGTCGCAAACTTATTA

ACGGAATCCGTGACAAGCAATCCGGCAAAACGATTCTGGATTTCTTGAAGTCGGACGGATTTGCTAATCGCAACTTC

ATGCAGTTGATCCATGATGACTCCCTGACTTTTAAAGAGGATATTCAAAAGGCGCAGGTTAGTGGTCAAGGCGACAG

```
CTTACACGAACACATCGCAAATTTGGCTGGTTCGCCGGCCATTAAAAAGGGGATCCTCCAGACCGTGAAAGTTGTAG
ATGAGCTTGTTAAGGTCATGGGTCGTCATAAGCCCGAAAACATCGTGATTGAAATGGCGCGGGAGAATCAAACGACC
CAGAAAGGACAAAAGAATAGCCGTGAACGGATGAAGCGGATCGAGGAAGGCATTAAAGAGCTGGGGTCTCAAATCTT
GAAGGAACACCCTGTGGAGAACACTCAGCTCCAAAATGAAAAACTTTACCTGTACTATTTGCAGAACGGACGCGATA
TGTACGTGGACCAAGAGTTGGATATTAATCGGCTGAGTGACTACGACGTTGATCATATCGTCCCGCAGAGCTTCCTC
AAAGACGATTCTATTGACAATAAGGTACTGACGCGCTCTGATAAAAACCGTGGTAAGTCGGACAACGTGCCCTCCGA
AGAGGTTGTGAAAAAGATGAAAAATTATTGGCGCCAGCTTTTAAACGCGAAGCTGATCACACAACGTAAATTCGATA
ATTTGACCAAGGCTGAACGGGGTGGCCTGAGCGAGTTAGATAAGGCAGGATTTATTAAACGCCAGTTAGTGGAGACT
CGTCAAATCACCAAACATGTCGCGCAGATTTTGGACAGCCGGATGAACACCAAGTACGATGAAAATGACAAACTGAT
CCGTGAGGTGAAAGTCATTACTCTGAAGTCCAAATTAGTTAGTGATTTCCGGAAGGACTTTCAATTCTACAAAGTCC
GTGAAATTAATAACTATCATCACGCACATGACGCGTACCTGAATGCAGTGGTTGGGACCGCCCTTATCAAGAAATAT
CCTAAGCTGGAGTCGGAGTTTGTCTATGGCGACTATAAGGTATACGATGTTCGCAAAATGATTGCGAAATCTGAGCA
GGAGATCGGTAAGGCAACCGCAAAATATTTCTTTTACTCAAACATTATGAATTTCTTTAAGACAGAAATCACTCTGG
CCAACGGGGAGATTCGCAAACGTCCGTTGATCGAAACAAACGGCGAGACTGGCGAAATTGTTTGGGACAAAGGGCGT
GATTTCGCGACGGTGCGCAAGGTACTGAGCATGCCTCAAGTCAATATTGTTAAGAAAACCGAAGTGCAGACGGGCGG
GTTTTCCAAGGAAAGCATCTTACCCAAACGTAATTCAGATAAACTTATTGCACGCAAAAAGGACTGGGATCCGAAAA
AGTATGGAGGCTTCGACAGTCCAACCGTAGCCTACTCTGTTCTCGTTGTAGCGAAAGTAGAAAAGGGTAAATCCAAG
AAACTGAAATCTGTCAAGGAGTTGCTTGGAATCACCATTATGGAGCGTAGCTCCTTCGAGAAGAACCCGATTGACTT
TCTGGAAGCCAAAGGATATAAAGAGGTCAAGAAAGATCTTATCATTAAGCTGCCTAAGTATTCACTCTTCGAGCTGG
AAAATGGTCGTAAACGCATGCTCGCTTCTGCCGGCGAGTTGCAGAAGGGCAATGAATTAGCACTTCCATCAAAGTAC
GTTAACTTCCTGTATTTGGCCAGCCATTACGAGAAACTGAAGGGGTCTCCAGAGGACAACGAACAGAAACAATTATT
TGTAGAGCAGCACAAGCATTATCTTGATGAAATCATTGAGCAAATTTCCGAATTCAGTAAACGCGTAATCCTGGCCG
ATGCAAACCTCGACAAGGTGCTGAGCGCTTACAATAAGCATCGCGACAAACCTATCCGTGAGCAGGCTGAAAATATC
ATTCACCTGTTCACATTAACGAACCTGGGCGCTCCGGCCGCTTTTAAATATTTCGACACGACAATCGACCGTAAGCG
CTATACCAGTACGAAAGAAGTGTTGGATGCGACCCTTATTCACCAGTCAATTACAGGATTATATGAGACCCGTATCG
ACCTTAGCCAATTAGGTGGGGATGCGCCAGCGCCTGCTCCTGCACCCGCTCCAGCTCCTGCGCCAGCTCCTGCACCT
GCGATGGTTAGCAAAGGTGAAGAACTGTTTACCGGCGTTGTGCCGATTCTGGTGGAACTGGATGGTGATGTGAATGG
CCATAAATTTAGCGTTagcGGCGAAGGCGAAGGTGATGCGACCtatGGTAAACTGACCCTGAAATTTATTTGCACCA
CCGGTAAACTGCCGGTTCCGTGGCCGACCCTGGTGACCACCCTGACCTATGGCGTTCAGTGCTTTAGCCGCTATCCG
GATCATATGAAAcagCATGATTTCTTTAAAAGCGCGATGCCGGAAGGCTATGTGCAGGAACGTACCATTttttTTCAA
AGATGATGGCaacTATAAAACCCGTGCGGAAGTTAAATTTGAAGGCGATACCCTGGTGAACCGCATTGAACTGAAAG
GTATTGATTTTAAAGAAGATGGCAACATTCTGGGTCATAAACTGGAATATAATtacAACAGCCATAATGTGTATATT
atgGCCGATAAACAGAAAAATGGCATCAAAgtgAACTTTAAAATCCGTCACAACattGAAGATGGTAGCGTGCAGCT
GGCGGATCATTATCAGCAGAATACCCCGATTGGTGATGGCCCGGTGCTGCTGCCGGATAATCATTATCTGAGCACCC
AGAGCgcgCTGAGCAAAGATCCGAATGAAAAACGTGATCATATGGTGCTGCTGGAATTTGTTACCGCCGCGGGCATT
ACCctgGGTATGGATGAACTGTATAAA
(Cas9-APAPAPAPAPAPAPAPAPAPAPA-eGFP chimera DNA sequence)
                                                              SEQ ID NO: 363
ATGGACAAAAAGTACTCTATTGGCCTGGATATCGGGACCAACAGCGTCGGGTGGCTGTTATCACCGACGAGTATAA
AGTACCTTCGAAAAAGTTCAAAGTGCTGGGCAACACCGATCGCCATTCAATCAAAAAGAACTTGATTGGTGCGCTGT
TGTTTGACTCCGGGGAAACCGCCGAGGCGACTCGCCTTAAACGTACAGCACGTCGCCGGTACACTCGGCGTAAGAAT
```

-continued

CGCATTTGCTATTTGCAGGAAATCTTTAGCAACGAGATGGCAAAGTCGATGACTCGTTTTTCCACCGCCTCGAGGA

AAGCTTTCTGGTGGAGGAAGACAAAAAGCATGAGCGTCACCCGATCTTCGGCAACATTGTCGATGAAGTAGCGTATC

ATGAAAAATACCCAACCATTTACCACTTACGCAAAAAGCTGGTGGACAGCACTGACAAAGCTGATTTGCGCCTTATC

TATTTAGCCCTGGCACATATGATTAAGTTTCGTGGTCACTTCCTGATCGAAGGAGACTTAAATCCCGACAACAGTGA

TGTTGATAAATTGTTTATTCAGCTTGTCCAAACTTACAATCAACTGTTCGAGGAAAACCCGATCAATGCCTCCGGTG

TGGATGCAAAAGCCATTTTAAGTGCACGCCTTAGCAAGTCCCGTCGCTTAGAAAACCTTATCGCGCAGCTGCCCGGC

GAGAAAAAGAATGGTTTGTTTGGGAACCTTATTGCCTTGAGCTTAGGCCTCACCCCGAATTTCAAAAGTAATTTCGA

TCTTGCAGAAGACGCCAAATTACAACTGTCGAAGGATACTTATGATGACGATCTCGATAATCTGTTAGCGCAGATTG

GTGACCAATACGCCGATCTTTTTCTGGCGGCTAAAAATCTGAGCGACGCCATCTTGCTTTCGGATATTCTCCGCGTT

AACACCGAAATCACGAAAGCGCCTCTTAGTGCCAGCATGATTAAACGTTATGATGAACACCACCAGGACCTGACCTT

ACTCAAAGCGTTGGTTCGCCAGCAACTGCCAGAGAAGTACAAAGAAATCTTCTTTGATCAGTCAAAGAATGGTTATG

CCGGCTATATTGACGGGGGTGCAAGCCAAGAGGAATTCTACAAATTTATCAAGCCTATTCTGGAGAAAATGGATGGC

ACCGAAGAGTTATTGGTGAAGCTTAACCGTGAAGACCTCCTGCGGAAACAGCGCACATTCGATAATGGTTCGATCCC

ACACCAAATCCATTTGGGGGAGTTACACGCTATTTTGCGTCGCCAGGAAGACTTTTACCCTTTCCTGAAGGATAACC

GGGAGAAAATTGAGAAGATCCTTACCTTTCGTATTCCGTATTACGTAGGCCCCTTAGCACGGGGTAATAGCCGTTTC

GCGTGGATGACACGGAAGTCGGAAGAGACGATCACCCCGTGGAACTTCGAAGAGGTAGTCGACAAGGGCGCATCAGC

GCAGTCTTTTATTGAACGTATGACGAATTTCGATAAAAACTTGCCCAATGAGAAGGTGCTTCCGAAACATTCCTTGT

TATATGAATATTTTACAGTTTACAACGAGCTGACCAAGGTTAAATACGTGACGGAAGGAATGCGCAAGCCCGCTTTT

CTTAGCGGTGAGCAAAAAAAGGCGATCGTCGACCTGTTATTCAAAACGAATCGTAAGGTGACTGTAAAGCAACTCAA

AGAAGATTACTTCAAAAAGATTGAGTGCTTCGACAGCGTCGAAATCTCTGGGGTAGAGGATCGGTTTAACGCAAGTT

TAGGTACCTACCATGACCTGCTTAAAATCATTAAGGATAAAGACTTCTTAGATAATGAAGAGAACGAAGATATTCTC

GAGGACATCGTCTTGACGTTAACCTTATTTGAGGATCGTGAAATGATTGAGGAACGCCTCAAAACTTATGCCCACCT

GTTCGACGATAAGGTGATGAAGCAGCTGAAACGTCGGCGCTACACAGGATGGGGCCGCTTGAGTCGCAAACTTATTA

ACGGAATCCGTGACAAGCAATCCGGCAAAACGATTCTGGATTTCTTGAAGTCGGACGGATTTGCTAATCGCAACTTC

ATGCAGTTGATCCATGATGACTCCCTGACTTTTAAAGAGGATATTCAAAAGGCGCAGGTTAGTGGTCAAGGCGACAG

CTTACACGAACACATCGCAAATTTGGCTGGTTCGCCGGCCATTAAAAAGGGGATCCTCCAGACCGTGAAAGTTGTAG

ATGAGCTTGTTAAGGTCATGGGTCGTCATAAGCCCGAAAACATCGTGATTGAAATGGCGCGGGAGAATCAAACGACC

CAGAAAGGACAAAAGAATAGCCGTGAACGGATGAAGCGGATCGAGGAAGGCATTAAAGAGCTGGGGTCTCAAATCTT

GAAGGAACACCCTGTGGAGAACACTCAGCTCCAAAATGAAAAACTTTACCTGTACTATTTGCAGAACGGACGCGATA

TGTACGTGGACCAAGAGTTGGATATTAATCGGCTGAGTGACTACGACGTTGATCATATCGTCCCGCAGAGCTTCCTC

AAAGACGATTCTATTGACAATAAGGTACTGACGCGCTCTGATAAAAACCGTGGTAAGTCGGACAACGTGCCCTCCGA

AGAGGTTGTGAAAAAGATGAAAAATTATTGGCGCCAGCTTTTAAACGCGAAGCTGATCACACAACGTAAATTCGATA

ATTTGACCAAGGCTGAACGGGGTGGCCTGAGCGAGTTAGATAAGGCAGGATTTATTAAACGCCAGTTAGTGGAGACT

CGTCAAATCACCAAACATGTCGCGCAGATTTTGGACAGCCGGATGAACACCAAGTACGATGAAAATGACAAACTGAT

CCGTGAGGTGAAAGTCATTACTCTGAAGTCCAAATTAGTTAGTGATTTCCGGAAGGACTTTCAATTCTACAAAGTCC

GTGAAATTAATAACTATCATCACGCACATGACGCGTACCTGAATGCAGTGGTTGGGACCGCCCTTATCAAGAAATAT

CCTAAGCTGGAGTCGGAGTTTGTCTATGGCGACTATAAGGTATACGATGTTCGCAAAATGATTGCGAAATCTGAGCA

GGAGATCGGTAAGGCAACCGCAAAATATTTCTTTTACTCAAACATTATGAATTTCTTTAAGACAGAAATCACTCTGG

CCAACGGGGAGATTCGCAAACGTCCGTTGATCGAAACAAACGGCGAGACTGGCGAAATTGTTTGGGACAAAGGGCGT

GATTTCGCGACGGTGCGCAAGGTACTGAGCATGCCTCAAGTCAATATTGTTAAGAAAACCGAAGTGCAGACGGGCGG

GTTTTCCAAGGAAAGCATCTTACCCAAACGTAATTCAGATAAACTTATTGCACGCAAAAAGGACTGGGATCCGAAAA

-continued

```
AGTATGGAGGCTTCGACAGTCCAACCGTAGCCTACTCTGTTCTCGTTGTAGCGAAAGTAGAAAAGGGTAAATCCAAG

AAACTGAAATCTGTCAAGGAGTTGCTTGGAATCACCATTATGGAGCGTAGCTCCTTCGAGAAGAACCCGATTGACTT

TCTGGAAGCCAAAGGATATAAAGAGGTCAAGAAAGATCTTATCATTAAGCTGCCTAAGTATTCACTCTTCGAGCTGG

AAAATGGTCGTAAACGCATGCTCGCTTCTGCCGGCGAGTTGCAGAAGGGCAATGAATTAGCACTTCCATCAAAGTAC

GTTAACTTCCTGTATTTGGCCAGCCATTACGAGAAACTGAAGGGGTCTCCAGAGGACAACGAACAGAAACAATTATT

TGTAGAGCAGCACAAGCATTATCTTGATGAAATCATTGAGCAAATTTCCGAATTCAGTAAACGCGTAATCCTGGCCG

ATGCAAACCTCGACAAGGTGCTGAGCGCTTACAATAAGCATCGCGACAAACCTATCCGTGAGCAGGCTGAAAATATC

ATTCACCTGTTCACATTAACGAACCTGGGCGCTCCGGCCGCTTTTAAATATTTCGACACGACAATCGACCGTAAGCG

CTATACCAGTACGAAAGAAGTGTTGGATGCGACCCTTATTCACCAGTCAATTACAGGATTATATGAGACCCGTATCG

ACCTTAGCCAATTAGGTGGGGATGCGCCAGCGCCTGCTCCTGCACCCGCTCCAGCTCCTGCTCCTGCGCCAGCTCCT

GCACCTGCGATGGTTAGCAAAGGTGAAGAACTGTTTACCGGCGTTGTGCCGATTCTGGTGGAACTGGATGGTGATGT

GAATGGCCATAAATTTAGCGTTagcGGCGAAGGCGAAGGTGATGCGACCtatGGTAAACTGACCCTGAAATTTATTT

GCACCACCGGTAAACTGCCGGTTCCGTGGCCGACCCTGGTGACCACCCTGACCTATGGCGTTCAGTGCTTTAGCCGC

TATCCGGATCATATGAAAcagCATGATTTCTTTAAAAGCGCGATGCCGGAAGGCTATGTGCAGGAACGTACCATTtt tTTCAAAGATGATGGCaacTATAAAACCCGTGCGGAAGTTAAATTTGAAGGCGATACCCTGGTGAACCGCATTGAAC TGAAAGGTATTGATTTTAAAGAAGATGGCAACATTCTGGGTCATAAACTGGAATATAATtacAACAGCCATAATGTG TATATTatgGCCGATAAACAGAAAAATGGCATCAAAgtgAACTTTAAAATCCGTCACAACattGAAGATGGTAGCGT

GCAGCTGGCGGATCATTATCAGCAGAATACCCCGATTGGTGATGGCCCGGTGCTGCTGCCGGATAATCATTATCTGA

GCACCCAGAGCgcgCTGAGCAAAGATCCGAATGAAAAACGTGATCATATGGTGCTGCTGGAATTTGTTACCGCCGCG

GGCATTACCctgGGTATGGATGAACTGTATAAA
```

(Cas9-APAPAPAPAPAPAPAPAPAPAPA-eGFP chimera DNA sequence)

SEQ ID NO: 364

```
ATGGACAAAAAGTACTCTATTGGCCTGGATATCGGGACCAACAGCGTCGGGTGGGCTGTTATCACCGACGAGTATAA

AGTACCTTCGAAAAAGTTCAAAGTGCTGGGCAACACCGATCGCCATTCAATCAAAAAGAACTTGATTGGTGCGCTGT

TGTTTGACTCCGGGGAAACCGCCGAGGCGACTCGCCTTAAACGTACAGCACGTCGCCGGTACACTCGGCGTAAGAAT

CGCATTTGCTATTTGCAGGAAATCTTTAGCAACGAGATGGCAAAAGTCGATGACTCGTTTTTCCACCGCCTCGAGGA

AAGCTTTCTGGTGGAGGAAGACAAAAAGCATGAGCGTCACCCGATCTTCGGCAACATTGTCGATGAAGTAGCGTATC

ATGAAAAATACCCAACCATTTACCACTTACGCAAAAAGCTGGTGGACAGCACTGACAAAGCTGATTTGCGCCTTATC

TATTTAGCCCTGGCACATATGATTAAGTTTCGTGGTCACTTCCTGATCGAAGGAGACTTAAATCCCGACAACAGTGA

TGTTGATAAATTGTTTATTCAGCTTGTCCAAACTTACAATCAACTGTTCGAGGAAAACCCGATCAATGCCTCCGGTG

TGGATGCAAAAGCCATTTTAAGTGCACGCCTTAGCAAGTCCCGTCGCTTAGAAAACCTTATCGCGCAGCTGCCCGGC

GAGAAAAAGAATGGTTTGTTTGGGAACCTTATTGCCTTGAGCTTAGGCCTCACCCCGAATTTCAAAAGTAATTTCGA

TCTTGCAGAAGACGCCAAATTACAACTGTCGAAGGATACTTATGATGACGATCTCGATAATCTGTTAGCGCAGATTG

GTGACCAATACGCCGATCTTTTTCTGGCGGCTAAAAATCTGAGCGACGCCATCTTGCTTTCGGATATTCTCCGCGTT

AACACCGAAATCACGAAAGCGCCTCTTAGTGCCAGCATGATTAAACGTTATGATGAACACCACCAGGACCTGACCTT

ACTCAAAGCGTTGGTTCGCCAGCAACTGCCAGAGAAGTACAAAGAAATCTTCTTTGATCAGTCAAAGAATGGTTATG

CCGGCTATATTGACGGGGGTGCAAGCCAAGAGGAATTCTACAAATTTATCAAGCCTATTCTGGAGAAAATGGATGGC

ACCGAAGAGTTATTGGTGAAGCTTAACCGTGAAGACCTCCTGCGGAAACAGCGCACATTCGATAATGGTTCGATCCC

ACACCAAATCCATTTGGGGGAGTTACACGCTATTTTGCGTCGCCAGGAAGACTTTTACCCTTTCCTGAAGGATAACC

GGGAGAAAATTGAGAAGATCCTTACCTTTCGTATTCCGTATTACGTAGGCCCCTTAGCACGGGGTAATAGCCGTTTC

GCGTGGATGACACGGAAGTCGGAAGAGACGATCACCCCGTGGAACTTCGAAGAGGTAGTCGACAAGGGCGCATCAGC
```

-continued

GCAGTCTTTTATTGAACGTATGACGAATTTCGATAAAAACTTGCCCAATGAGAAGGTGCTTCCGAAACATTCCTTGT
TATATGAATATTTTACAGTTTACAACGAGCTGACCAAGGTTAAATACGTGACGGAAGGAATGCGCAAGCCCGCTTTT
CTTAGCGGTGAGCAAAAAAGGCGATCGTCGACCTGTTATTCAAAACGAATCGTAAGGTGACTGTAAAGCAACTCAA
AGAAGATTACTTCAAAAAGATTGAGTGCTTCGACAGCGTCGAAATCTCTGGGGTAGAGGATCGGTTTAACGCAAGTT
TAGGTACCTACCATGACCTGCTTAAAATCATTAAGGATAAAGACTTCTTAGATAATGAAGAGAACGAAGATATTCTC
GAGGACATCGTCTTGACGTTAACCTTATTTGAGGATCGTGAAATGATTGAGGAACGCCTCAAAACTTATGCCCACCT
GTTCGACGATAAGGTGATGAAGCAGCTGAAACGTCGGCGCTACACAGGATGGGGCCGCTTGAGTCGCAAACTTATTA
ACGGAATCCGTGACAAGCAATCCGGCAAAACGATTCTGGATTTCTTGAAGTCGGACGGATTTGCTAATCGCAACTTC
ATGCAGTTGATCCATGATGACTCCCTGACTTTTAAAGAGGATATTCAAAAGGCGCAGGTTAGTGGTCAAGGCGACAG
CTTACACGAACACATCGCAAATTTGGCTGGTTCGCCGGCCATTAAAAAGGGGATCCTCCAGACCGTGAAAGTTGTAG
ATGAGCTTGTTAAGGTCATGGGTCGTCATAAGCCCGAAAACATCGTGATTGAAATGGCGCGGGAGAATCAAACGACC
CAGAAAGGACAAAAGAATAGCCGTGAACGGATGAAGCGGATCGAGGAAGGCATTAAAGAGCTGGGGTCTCAAATCTT
GAAGGAACACCCTGTGGAGAACACTCAGCTCCAAAATGAAAAACTTTACCTGTACTATTTGCAGAACGGACGCGATA
TGTACGTGGACCAAGAGTTGGATATTAATCGGCTGAGTGACTACGACGTTGATCATATCGTCCCGCAGAGCTTCCTC
AAAGACGATTCTATTGACAATAAGGTACTGACGCGCTCTGATAAAAACCGTGGTAAGTCGGACAACGTGCCCTCCGA
AGAGGTTGTGAAAAAGATGAAAAATTATTGGCGCCAGCTTTTAAACGCGAAGCTGATCACACAACGTAAATTCGATA
ATTTGACCAAGGCTGAACGGGGTGGCCTGAGCGAGTTAGATAAGGCAGGATTTATTAAACGCCAGTTAGTGGAGACT
CGTCAAATCACCAAACATGTCGCGCAGATTTTGGACAGCCGGATGAACACCAAGTACGATGAAAATGACAAACTGAT
CCGTGAGGTGAAAGTCATTACTCTGAAGTCCAAATTAGTTAGTGATTTCCGGAAGGACTTTCAATTCTACAAAGTCC
GTGAAATTAATAACTATCATCACGCACATGACGCGTACCTGAATGCAGTGGTTGGGACCGCCCTTATCAAGAAATAT
CCTAAGCTGGAGTCGGAGTTTGTCTATGGCGACTATAAGGTATACGATGTTCGCAAAATGATTGCGAAATCTGAGCA
GGAGATCGGTAAGGCAACCGCAAAATATTTCTTTTACTCAAACATTATGAATTTCTTTAAGACAGAAATCACTCTGG
CCAACGGGGAGATTCGCAAACGTCCGTTGATCGAAACAAACGGCGAGACTGGCGAAATTGTTTGGGACAAAGGGCGT
GATTTCGCGACGGTGCGCAAGGTACTGAGCATGCCTCAAGTCAATATTGTTAAGAAAACCGAAGTGCAGACGGGCGG
GTTTTCCAAGGAAAGCATCTTACCCAAACGTAATTCAGATAAACTTATTGCACGCAAAAAGGACTGGGATCCGAAAA
AGTATGGAGGCTTCGACAGTCCAACCGTAGCCTACTCTGTTCTCGTTGTAGCGAAAGTAGAAAAGGGTAAATCCAAG
AAACTGAAATCTGTCAAGGAGTTGCTTGGAATCACCATTATGGAGCGTAGCTCCTTCGAGAAGAACCCGATTGACTT
TCTGGAAGCCAAAGGATATAAAGAGGTCAAGAAAGATCTTATCATTAAGCTGCCTAAGTATTCACTCTTCGAGCTGG
AAAATGGTCGTAAACGCATGCTCGCTTCTGCCGGCGAGTTGCAGAAGGGCAATGAATTAGCACTTCCATCAAAGTAC
GTTAACTTCCTGTATTTGGCCAGCCATTACGAGAAACTGAAGGGGTCTCCAGAGGACAACGAACAGAAACAATTATT
TGTAGAGCAGCACAAGCATTATCTTGATGAAATCATTGAGCAAATTTCCGAATTCAGTAAACGCGTAATCCTGGCCG
ATGCAAACCTCGACAAGGTGCTGAGCGCTTACAATAAGCATCGCGACAAACCTATCCGTGAGCAGGCTGAAAATATC
ATTCACCTGTTCACATTAACGAACCTGGGCGCTCCGGCCGCTTTTAAATATTTCGACACGACAATCGACCGTAAGCG
CTATACCAGTACGAAAGAAGTGTTGGATGCGACCCTTATTCACCAGTCAATTACAGGATTATATGAGACCCGTATCG
ACCTTAGCCAATTAGGTGGGGATGCGCCAGCGCCTGCTCCTGCACCCGCTCCAGCTCCTGCCCCAGCTCCAGCGCCC
GCTCCTGCACCTGCGATGGTTAGCAAAGGTGAAGAACTGTTTACCGGCGTTGTGCCGATTCTGGTGGAACTGGATGG
TGATGTGAATGGCCATAAATTTAGCGTTagcGGCGAAGGCGAAGGTGATGCGACCtatGGTAAACTGACCCTGAAAT
TTATTTGCACCACCGGTAAACTGCCGGTTCCGTGGCCGACCCTGGTGACCACCCTGACCTATGGCGTTCAGTGCTTT
AGCCGCTATCCGGATCATATGAAAcagCATGATTTCTTTAAAAGCGCGATGCCGGAAGGCTATGTGCAGGAACGTAC
CATTtttTTCAAAGATGATGGCaacTATAAAACCGTGCGGAAGTTAAATTTGAAGGCGATACCCTGGTGAACCGCA
TTGAACTGAAAGGTATTGATTTTAAAGAAGATGGCAACATTCTGGGTCATAAACTGGAATATAATtacAACAGCCAT AATGTGTATATTatgGCCGATAAACAGAAAAATGGCATCAAAgtgAACTTTAAAATCCGTCACAACattGAAGATGG

TAGCGTGCAGCTGGCGGATCATTATCAGCAGAATACCCCGATTGGTGATGGCCCGGTGCTGCTGCCGGATAATCATT

ATCTGAGCACCCAGAGCgcgCTGAGCAAAGATCCGAATGAAAAACGTGATCATATGGTGCTGCTGGAATTTGTTACC

GCCGCGGGCATTACCctgGGTATGGATGAACTGTATAAA (Cas9-APAPAPAPAPAPAPAPAPAPAPAPAPAPA-eGFP chimera DNA sequence)

SEQ ID NO: 365

ATGGACAAAAAGTACTCTATTGGCCTGGATATCGGGACCAACAGCGTCGGGTGGGCTGTTATCACCGACGAGTATAA

AGTACCTTCGAAAAAGTTCAAAGTGCTGGGCAACACCGATCGCCATTCAATCAAAAAGAACTTGATTGGTGCGCTGT

TGTTTGACTCCGGGGAAACCGCCGAGGCGACTCGCCTTAAACGTACAGCACGTCGCCGGTACACTCGGCGTAAGAAT

CGCATTTGCTATTTGCAGGAAATCTTTAGCAACGAGATGGCAAAAGTCGATGACTCGTTTTTCCACCGCCTCGAGGA

AAGCTTTCTGGTGGAGGAAGACAAAAAGCATGAGCGTCACCCGATCTTCGGCAACATTGTCGATGAAGTAGCGTATC

ATGAAAAATACCCAACCATTTACCACTTACGCAAAAAGCTGGTGGACAGCACTGACAAAGCTGATTTGCGCCTTATC

TATTTAGCCCTGGCACATATGATTAAGTTTCGTGGTCACTTCCTGATCGAAGGAGACTTAAATCCCGACAACAGTGA

TGTTGATAAATTGTTTATTCAGCTTGTCCAAACTTACAATCAACTGTTCGAGGAAAACCCGATCAATGCCTCCGGTG

TGGATGCAAAAGCCATTTTAAGTGCACGCCTTAGCAAGTCCCGTCGCTTAGAAAACCTTATCGCGCAGCTGCCCGGC

GAGAAAAAGAATGGTTTGTTTGGGAACCTTATTGCCTTGAGCTTAGGCCTCACCCCGAATTTCAAAAGTAATTTCGA

TCTTGCAGAAGACGCCAAATTACAACTGTCGAAGGATACTTATGATGACGATCTCGATAATCTGTTAGCGCAGATTG

GTGACCAATACGCCGATCTTTTTCTGGCGGCTAAAAATCTGAGCGACGCCATCTTGCTTTCGGATATTCTCCGCGTT

AACACCGAAATCACGAAAGCGCCTCTTAGTGCCAGCATGATTAAACGTTATGATGAACACCACCAGGACCTGACCTT

ACTCAAAGCGTTGGTTCGCCAGCAACTGCCAGAGAAGTACAAAGAAATCTTCTTTGATCAGTCAAAGAATGGTTATG

CCGGCTATATTGACGGGGGTGCAAGCCAAGAGGAATTCTACAAATTTATCAAGCCTATTCTGGAGAAAATGGATGGC

ACCGAAGAGTTATTGGTGAAGCTTAACCGTGAAGACCTCCTGCGGAAACAGCGCACATTCGATAATGGTTCGATCCC

ACACCAAATCCATTTGGGGGAGTTACACGCTATTTTGCGTCGCCAGGAAGACTTTTACCCTTTCCTGAAGGATAACC

GGGAGAAAATTGAGAAGATCCTTACCTTTCGTATTCCGTATTACGTAGGCCCCTTAGCACGGGGTAATAGCCGTTTC

GCGTGGATGACACGGAAGTCGGAAGAGACGATCACCCCGTGGAACTTCGAAGAGGTAGTCGACAAGGGCGCATCAGC

GCAGTCTTTTATTGAACGTATGACGAATTTCGATAAAAACTTGCCCAATGAGAAGGTGCTTCCGAAACATTCCTTGT

TATATGAATATTTTACAGTTTACAACGAGCTGACCAAGGTTAAATACGTGACGGAAGGAATGCGCAAGCCCGCTTTT

CTTAGCGGTGAGCAAAAAAAGGCGATCGTCGACCTGTTATTCAAAACGAATCGTAAGGTGACTGTAAAGCAACTCAA

AGAAGATTACTTCAAAAAGATTGAGTGCTTCGACAGCGTCGAAATCTCTGGGGTAGAGGATCGGTTTAACGCAAGTT

TAGGTACCTACCATGACCTGCTTAAAATCATTAAGGATAAAGACTTCTTAGATAATGAAGAGAACGAAGATATTCTC

GAGGACATCGTCTTGACGTTAACCTTATTTGAGGATCGTGAAATGATTGAGGAACGCCTCAAAACTTATGCCCACCT

GTTCGACGATAAGGTGATGAAGCAGCTGAAACGTCGGCGCTACACAGGATGGGGCCGCTTGAGTCGCAAACTTATTA

ACGGAATCCGTGACAAGCAATCCGGCAAAACGATTCTGGATTTCTTGAAGTCGGACGGATTTGCTAATCGCAACTTC

ATGCAGTTGATCCATGATGACTCCCTGACTTTTAAAGAGGATATTCAAAAGGCGCAGGTTAGTGGTCAAGGCGACAG

CTTACACGAACACATCGCAAATTTGGCTGGTTCGCCGGCCATTAAAAAGGGGATCCTCCAGACCGTGAAAGTTGTAG

ATGAGCTTGTTAAGGTCATGGGTCGTCATAAGCCCGAAAACATCGTGATTGAAATGGCGCGGGAGAATCAAACGACC

CAGAAAGGACAAAAGAATAGCCGTGAACGGATGAAGCGGATCGAGGAAGGCATTAAAGAGCTGGGGTCTCAAATCTT

GAAGGAACACCCTGTGGAGAACACTCAGCTCCAAAATGAAAAACTTTACCTGTACTATTTGCAGAACGGACGCGATA

TGTACGTGGACCAAGAGTTGGATATTAATCGGCTGAGTGACTACGACGTTGATCATATCGTCCCGCAGAGCTTCCTC

AAAGACGATTCTATTGACAATAAGGTACTGACGCGCTCTGATAAAAACCGTGGTAAGTCGGACAACGTGCCCTCCGA

AGAGGTTGTGAAAAAGATGAAAAATTATTGGCGCCAGCTTTTAAACGCGAAGCTGATCACACAACGTAAATTCGATA

-continued

```
ATTTGACCAAGGCTGAACGGGGTGGCCTGAGCGAGTTAGATAAGGCAGGATTTATTAAACGCCAGTTAGTGGAGACT
CGTCAAATCACCAAACATGTCGCGCAGATTTTGGACAGCCGGATGAACACCAAGTACGATGAAAATGACAAACTGAT
CCGTGAGGTGAAAGTCATTACTCTGAAGTCCAAATTAGTTAGTGATTTCCGGAAGGACTTTCAATTCTACAAAGTCC
GTGAAATTAATAACTATCATCACGCACATGACGCGTACCTGAATGCAGTGGTTGGGACCGCCCTTATCAAGAAATAT
CCTAAGCTGGAGTCGGAGTTTGTCTATGGCGACTATAAGGTATACGATGTTCGCAAAATGATTGCGAAATCTGAGCA
GGAGATCGGTAAGGCAACCGCAAAATATTTCTTTTACTCAAACATTATGAATTTCTTTAAGACAGAAATCACTCTGG
CCAACGGGGAGATTCGCAAACGTCCGTTGATCGAAACAAACGGCGAGACTGGCGAAATTGTTTGGGACAAAGGGCGT
GATTTCGCGACGGTGCGCAAGGTACTGAGCATGCCTCAAGTCAATATTGTTAAGAAAACCGAAGTGCAGACGGGCGG
GTTTTCCAAGGAAAGCATCTTACCCAAACGTAATTCAGATAAACTTATTGCACGCAAAAAGGACTGGGATCCGAAAA
AGTATGGAGGCTTCGACAGTCCAACCGTAGCCTACTCTGTTCTCGTTGTAGCGAAAGTAGAAAAGGGTAAATCCAAG
AAACTGAAATCTGTCAAGGAGTTGCTTGGAATCACCATTATGGAGCGTAGCTCCTTCGAGAAGAACCCGATTGACTT
TCTGGAAGCCAAAGGATATAAAGAGGTCAAGAAAGATCTTATCATTAAGCTGCCTAAGTATTCACTCTTCGAGCTGG
AAAATGGTCGTAAACGCATGCTCGCTTCTGCCGGCGAGTTGCAGAAGGGCAATGAATTAGCACTTCCATCAAAGTAC
GTTAACTTCCTGTATTTGGCCAGCCATTACGAGAAACTGAAGGGGTCTCCAGAGGACAACGAACAGAAACAATTATT
TGTAGAGCAGCACAAGCATTATCTTGATGAAATCATTGAGCAAATTTCCGAATTCAGTAAACGCGTAATCCTGGCCG
ATGCAAACCTCGACAAGGTGCTGAGCGCTTACAATAAGCATCGCGACAAACCTATCCGTGAGCAGGCTGAAAATATC
ATTCACCTGTTCACATTAACGAACCTGGGCGCTCCGGCCGCTTTTAAATATTTCGACACGACAATCGACCGTAAGCG
CTATACCAGTACGAAAGAAGTGTTGGATGCGACCCTTATTCACCAGTCAATTACAGGATTATATGAGACCCGTATCG
ACCTTAGCCAATTAGGTGGGGATGCGCCAGCGCCTGCTCCTGCACCCGCTCCAGCTCCTGCCCCAGCTCCAGCGCCC
GCTCCTGCTCCTGCACCTGCGATGGTTAGCAAAGGTGAAGAACTGTTTACCGGCGTTGTGCCGATTCTGGTGGAACT
GGATGGTGATGTGAATGGCCATAAATTTAGCGTTagcGGCGAAGGCGAAGGTGATGCGACCtatGGTAAACTGACCC
TGAAATTTATTTGCACCACCGGTAAACTGCCGGTTCCGTGGCCGACCCTGGTGACCACCCTGACCTATGGCGTTCAG
TGCTTTAGCCGCTATCCGGATCATATGAAAcagCATGATTTCTTTAAAAGCGCGATGCCGGAAGGCTATGTGCAGGA
ACGTACCATTtttTTCAAAGATGATGGCaacTATAAAACCCGTGCGGAAGTTAAATTTGAAGGCGATACCCTGGTGA
ACCGCATTGAACTGAAAGGTATTGATTTTAAAGAAGATGGCAACATTCTGGGTCATAAACTGGAATATAATtacAAC
AGCCATAATGTGTATATTatgGCCGATAAACAGAAAAATGGCATCAAAgtgAACTTTAAAATCCGTCACAACattGA
AGATGGTAGCGTGCAGCTGGCGGATCATTATCAGCAGAATACCCCGATTGGTGATGGCCCGGTGCTGCTGCCGGATA
ATCATTATCTGAGCACCCAGAGCgcgCTGAGCAAAGATCCGAATGAAAACGTGATCATATGGTGCTGCTGGAATTT
GTTACCGCCGCGGGCATTACCctgGGTATGGATGAACTGTATAAA
```

(Cas9-APAPAPAPAPAPAPAPAPAPAPAPAPA-eGFP chimera DNA sequence)

SEQ ID NO: 366

```
ATGGACAAAAAGTACTCTATTGGCCTGGATATCGGGACCAACAGCGTCGGGTGGGCTGTTATCACCGACGAGTATAA
AGTACCTTCGAAAAAGTTCAAAGTGCTGGGCAACACCGATCGCCATTCAATCAAAAAGAACTTGATTGGTGCGCTGT
TGTTTGACTCCGGGGAAACCGCCGAGGCGACTCGCCTTAAACGTACAGCACGTCGCCGGTACACTCGGCGTAAGAAT
CGCATTTGCTATTTGCAGGAAATCTTTAGCAACGAGATGGCAAAAGTCGATGACTCGTTTTTCCACCGCCTCGAGGA
AAGCTTTCTGGTGGAGGAAGACAAAAAGCATGAGCGTCACCCGATCTTCGGCAACATTGTCGATGAAGTAGCGTATC
ATGAAAAATACCCAACCATTTACCACTTACGCAAAAAGCTGGTGGACAGCACTGACAAAGCTGATTTGCGCCTTATC
TATTTAGCCCTGGCACATATGATTAAGTTCGTGGTCACTTCCTGATCGAAGGAGACTTAAATCCCGACAACAGTGA
TGTTGATAAATTGTTTATTCAGCTTGTCCAAACTTACAATCAACTGTTCGAGGAAAACCCGATCAATGCCTCCGGTG
TGGATGCAAAAGCCATTTTAAGTGCACGCCTTAGCAAGTCCCGTCGCTTAGAAAACCTTATCGCGCAGCTGCCCGGC
GAGAAAAAGAATGGTTTGTTTGGGAACCTTATTGCCTTGAGCTTAGGCCTCACCCCGAATTTCAAAAGTAATTTCGA
TCTTGCAGAAGACGCCAAATTACAACTGTCGAAGGATACTTATGATGACGATCTCGATAATCTGTTAGCGCAGATTG
```

-continued

```
GTGACCAATACGCCGATCTTTTTCTGGCGGCTAAAAATCTGAGCGACGCCATCTTGCTTTCGGATATTCTCCGCGTT
AACACCGAAATCACGAAAGCGCCTCTTAGTGCCAGCATGATTAAACGTTATGATGAACACCACCAGGACCTGACCTT
ACTCAAAGCGTTGGTTCGCCAGCAACTGCCAGAGAAGTACAAAGAAATCTTCTTTGATCAGTCAAAGAATGGTTATG
CCGGCTATATTGACGGGGGTGCAAGCCAAGAGGAATTCTACAAATTTATCAAGCCTATTCTGGAGAAAATGGATGGC
ACCGAAGAGTTATTGGTGAAGCTTAACCGTGAAGACCTCCTGCGGAAACAGCGCACATTCGATAATGGTTCGATCCC
ACACCAAATCCATTTGGGGGAGTTACACGCTATTTTGCGTCGCCAGGAAGACTTTTACCCTTTCCTGAAGGATAACC
GGGAGAAAATTGAGAAGATCCTTACCTTTCGTATTCCGTATTACGTAGGCCCCTTAGCACGGGGTAATAGCCGTTTC
GCGTGGATGACACGGAAGTCGGAAGAGACGATCACCCCGTGGAACTTCGAAGAGGTAGTCGACAAGGGCGCATCAGC
GCAGTCTTTTATTGAACGTATGACGAATTTCGATAAAAACTTGCCCAATGAGAAGGTGCTTCCGAAACATTCCTTGT
TATATGAATATTTTACAGTTTACAACGAGCTGACCAAGGTTAAATACGTGACGGAAGGAATGCGCAAGCCCGCTTTT
CTTAGCGGTGAGCAAAAAAGGCGATCGTCGACCTGTTATTCAAAACGAATCGTAAGGTGACTGTAAAGCAACTCAA
AGAAGATTACTTCAAAAAGATTGAGTGCTTCGACAGCGTCGAAATCTCTGGGGTAGAGGATCGGTTTAACGCAAGTT
TAGGTACCTACCATGACCTGCTTAAAATCATTAAGGATAAAGACTTCTTAGATAATGAAGAGAACGAAGATATTCTC
GAGGACATCGTCTTGACGTTAACCTTATTTGAGGATCGTGAAATGATTGAGGAACGCCTCAAAACTTATGCCCACCT
GTTCGACGATAAGGTGATGAAGCAGCTGAAACGTCGGCGCTACACAGGATGGGGCCGCTTGAGTCGCAAACTTATTA
ACGGAATCCGTGACAAGCAATCCGGCAAAACGATTCTGGATTTCTTGAAGTCGGACGGATTTGCTAATCGCAACTTC
ATGCAGTTGATCCATGATGACTCCCTGACTTTTAAAGAGGATATTCAAAAGGCGCAGGTTAGTGGTCAAGGCGACAG
CTTACACGAACACATCGCAAATTTGGCTGGTTCGCCGGCCATTAAAAAGGGGATCCTCCAGACCGTGAAAGTTGTAG
ATGAGCTTGTTAAGGTCATGGGTCGTCATAAGCCCGAAAACATCGTGATTGAAATGGCGCGGGAGAATCAAACGACC
CAGAAAGGACAAAAGAATAGCCGTGAACGGATGAAGCGGATCGAGGAAGGCATTAAAGAGCTGGGGTCTCAAATCTT
GAAGGAACACCCTGTGGAGAACACTCAGCTCCAAAATGAAAAACTTTACCTGTACTATTTGCAGAACGGACGCGATA
TGTACGTGGACCAAGAGTTGGATATTAATCGGCTGAGTGACTACGACGTTGATCATATCGTCCCGCAGAGCTTCCTC
AAAGACGATTCTATTGACAATAAGGTACTGACGCGCTCTGATAAAAACCGTGGTAAGTCGGACAACGTGCCCTCCGA
AGAGGTTGTGAAAAAGATGAAAAATTATTGGCGCCAGCTTTTAAACGCGAAGCTGATCACACAACGTAAATTCGATA
ATTTGACCAAGGCTGAACGGGGTGGCCTGAGCGAGTTAGATAAGGCAGGATTTATTAAACGCCAGTTAGTGGAGACT
CGTCAAATCACCAAACATGTCGCGCAGATTTTGGACAGCCGGATGAACACCAAGTACGATGAAAATGACAAACTGAT
CCGTGAGGTGAAAGTCATTACTCTGAAGTCCAAATTAGTTAGTGATTTCCGGAAGGACTTTCAATTCTACAAAGTCC
GTGAAATTAATAACTATCATCACGCACATGACGCGTACCTGAATGCAGTGGTTGGGACCGCCCTTATCAAGAAATAT
CCTAAGCTGGAGTCGGAGTTTGTCTATGGCGACTATAAGGTATACGATGTTCGCAAATGATTGCGAAATCTGAGCA
GGAGATCGGTAAGGCAACCGCAAAATATTTCTTTTACTCAAACATTATGAATTTCTTTAAGACAGAAATCACTCTGG
CCAACGGGGAGATTCGCAAACGTCCGTTGATCGAAACAAACGGCGAGACTGGCGAAATTGTTTGGGACAAAGGGCGT
GATTTCGCGACGGTGCGCAAGGTACTGAGCATGCCTCAAGTCAATATTGTTAAGAAAACCGAAGTGCAGACGGGCGG
GTTTTCCAAGGAAAGCATCTTACCCAAACGTAATTCGATAAACTTATTGCACGCAAAAAGGACTGGGATCCGAAAA
AGTATGGAGGCTTCGACAGTCCAACCGTAGCCTACTCTGTTCTCGTTGTAGCGAAAGTAGAAAAGGGTAAATCCAAG
AAACTGAAATCTGTCAAGGAGTTGCTTGGAATCACCATTATGGAGCGTAGCTCCTTCGAGAAGAACCCGATTGACTT
TCTGGAAGCCAAAGGATATAAAGAGGTCAAGAAAGATCTTATCATTAAGCTGCCTAAGTATTCACTCTTCGAGCTGG
AAAATGGTCGTAAACGCATGCTCGCTTCTGCCGGCGAGTTGCAGAAGGGCAATGAATTAGCACTTCCATCAAAGTAC
GTTAACTTCCTGTATTTGGCCAGCCATTACGAGAAACTGAAGGGGTCTCCAGAGGACAACGAACAGAAACAATTATT
TGTAGAGCAGCACAAGCATTATCTTGATGAAATCATTGAGCAAATTTCCGAATTCAGTAAACGCGTAATCCTGGCCG
ATGCAAACCTCGACAAGGTGCTGAGCGCTTACAATAAGCATCGCGACAAACCTATCCGTGAGCAGGCTGAAAATATC
```

-continued

ATTCACCTGTTCACATTAACGAACCTGGGCGCTCCGGCCGCTTTTAAATATTTCGACACGACAATCGACCGTAAGCG

CTATACCAGTACGAAAGAAGTGTTGGATGCGACCCTTATTCACCAGTCAATTACAGGATTATATGAGACCCGTATCG

ACCTTAGCCAATTAGGTGGGGATGCGCCAGCGCCTGCTCCTGCACCCGCTCCAGCTCCTGCCCCAGCTCCAGCGCCC

GCTCCTGCGCCAGCTCCTGCACCTGCGATGGTTAGCAAAGGTGAAGAACTGTTTACCGGCGTTGTGCCGATTCTGGT

GGAACTGGATGGTGATGTGAATGGCCATAAATTTAGCGTTagcGGCGAAGGCGAAGGTGATGCGACCtatGGTAAAC

TGACCCTGAAATTTATTTGCACCACCGGTAAACTGCCGGTTCCGTGGCCGACCCTGGTGACCACCCTGACCTATGGC

GTTCAGTGCTTTAGCCGCTATCCGGATCATATGAAAcagCATGATTTCTTTAAAAGCGCGATGCCGGAAGGCTATGT

GCAGGAACGTACCATTtttTTCAAAGATGATGGCaacTATAAAACCCGTGCGGAAGTTAAATTTGAAGGCGATACCC

TGGTGAACCGCATTGAACTGAAAGGTATTGATTTTAAAGAAGATGGCAACATTCTGGGTCATAAACTGGAATATAAT tacAACAGCCATAATGTGTATATTatgGCCGATAAACAGAAAAATGGCATCAAAgtgAACTTTAAAATCCGTCACAA CattGAAGATGGTAGCGTGCAGCTGGCGGATCATTATCAGCAGAATACCCCGATTGGTGATGGCCCGGTGCTGCTGC CGGATAATCATTATCTGAGCACCCAGAGCgcgCTGAGCAAAGATCCGAATGAAAAACGTGATCATATGGTGCTGCTG GAATTTGTTACCGCCGCGGGCATTACCctgGGTATGGATGAACTGTATAAA (Cas9-APAPAPAPAPAPAPAPAPAPAPAPAPAPAPA-eGFP chimera DNA sequence)

SEQ ID NO: 367

ATGGACAAAAAGTACTCTATTGGCCTGGATATCGGGACCAACAGCGTCGGGTGGGCTGTTATCACCGACGAGTATAA

AGTACCTTCGAAAAAGTTCAAAGTGCTGGGCAACACCGATCGCCATTCAATCAAAAAGAACTTGATTGGTGCGCTGT

TGTTTGACTCCGGGGAAACCGCCGAGGCGACTCGCCTTAAACGTACAGCACGTCGCCGGTACACTCGGCGTAAGAAT

CGCATTTGCTATTTGCAGGAAATCTTTAGCAACGAGATGGCAAAAGTCGATGACTCGTTTTTCCACCGCCTCGAGGA

AAGCTTTCTGGTGGAGGAAGACAAAAAGCATGAGCGTCACCCGATCTTCGGCAACATTGTCGATGAAGTAGCGTATC

ATGAAAAATACCCAACCATTTACCACTTACGCAAAAAGCTGGTGGACAGCACTGACAAAGCTGATTTGCGCCTTATC

TATTTAGCCCTGGCACATATGATTAAGTTTCGTGGTCACTTCCTGATCGAAGGAGACTTAAATCCCGACAACAGTGA

TGTTGATAAATTGTTTATTCAGCTTGTCCAAACTTACAATCAACTGTTCGAGGAAAACCCGATCAATGCCTCCGGTG

TGGATGCAAAAGCCATTTTAAGTGCACGCCTTAGCAAGTCCCGTCGCTTAGAAAACCTTATCGCGCAGCTGCCCGGC

GAGAAAAAGAATGGTTTGTTTGGGAACCTTATTGCCTTGAGCTTAGGCCTCACCCCGAATTTCAAAAGTAATTTCGA

TCTTGCAGAAGACGCCAAATTACAACTGTCGAAGGATACTTATGATGACGATCTCGATAATCTGTTAGCGCAGATTG

GTGACCAATACGCCGATCTTTTTCTGGCGGCTAAAAATCTGAGCGACGCCATCTTGCTTTCGGATATTCTCCGCGTT

AACACCGAAATCACGAAAGCGCCTCTTAGTGCCAGCATGATTAAACGTTATGATGAACACCACCAGGACCTGACCTT

ACTCAAAGCGTTGGTTCGCCAGCAACTGCCAGAGAAGTACAAAGAAATCTTCTTTGATCAGTCAAAGAATGGTTATG

CCGGCTATATTGACGGGGGTGCAAGCCAAGAGGAATTCTACAAATTTATCAAGCCTATTCTGGAGAAAATGGATGGC

ACCGAAGAGTTATTGGTGAAGCTTAACCGTGAAGACCTCCTGCGGAAACAGCGCACATTCGATAATGGTTCGATCCC

ACACCAAATCCATTTGGGGGAGTTACACGCTATTTTGCGTCGCCAGGAAGACTTTTACCCTTTCCTGAAGGATAACC

GGGAGAAAATTGAGAAGATCCTTACCTTTCGTATTCCGTATTACGTAGGCCCCTTAGCACGGGGTAATAGCCGTTTC

GCGTGGATGACACGGAAGTCGGAAGAGACGATCACCCCGTGGAACTTCGAAGAGGTAGTCGACAAGGGCGCATCAGC

GCAGTCTTTTATTGAACGTATGACGAATTTCGATAAAAACTTGCCCAATGAGAAGGTGCTTCCGAAACATTCCTTGT

TATATGAATATTTTACAGTTTACAACGAGCTGACCAAGGTTAAATACGTGACGGAAGGAATGCGCAAGCCCGCTTTT

CTTAGCGGTGAGCAAAAAAAGGCGATCGTCGACCTGTTATTCAAAACGAATCGTAAGGTGACTGTAAAGCAACTCAA

AGAAGATTACTTCAAAAAGATTGAGTGCTTCGACAGCGTCGAAATCTCTGGGGTAGAGGATCGGTTTAACGCAAGTT

TAGGTACCTACCATGACCTGCTTAAAATCATTAAGGATAAAGACTTCTTAGATAATGAAGAGAACGAAGATATTCTC

GAGGACATCGTCTTGACGTTAACCTTATTTGAGGATCGTGAAATGATTGAGGAACGCCTCAAAACTTATGCCCACCT

GTTCGACGATAAGGTGATGAAGCAGCTGAAACGTCGGCGCTACACAGGATGGGGCCGCTTGAGTCGCAAACTTATTA

ACGGAATCCGTGACAAGCAATCCGGCAAAACGATTCTGGATTTCTTGAAGTCGGACGGATTTGCTAATCGCAACTTC

-continued

ATGCAGTTGATCCATGATGACTCCCTGACTTTTAAAGAGGATATTCAAAAGGCGCAGGTTAGTGGTCAAGGCGACAG
CTTACACGAACACATCGCAAATTTGGCTGGTTCGCCGGCCATTAAAAAGGGGATCCTCCAGACCGTGAAAGTTGTAG
ATGAGCTTGTTAAGGTCATGGGTCGTCATAAGCCCGAAAACATCGTGATTGAAATGGCGCGGGAGAATCAAACGACC
CAGAAAGGACAAAAGAATAGCCGTGAACGGATGAAGCGGATCGAGGAAGGCATTAAAGAGCTGGGGTCTCAAATCTT
GAAGGAACACCCTGTGGAGAACACTCAGCTCCAAAATGAAAAACTTTACCTGTACTATTTGCAGAACGGACGCGATA
TGTACGTGGACCAAGAGTTGGATATTAATCGGCTGAGTGACTACGACGTTGATCATATCGTCCCGCAGAGCTTCCTC
AAAGACGATTCTATTGACAATAAGGTACTGACGCGCTCTGATAAAAACCGTGGTAAGTCGGACAACGTGCCCTCCGA
AGAGGTTGTGAAAAAGATGAAAAATTATTGGCGCCAGCTTTTAAACGCGAAGCTGATCACACAACGTAAATTCGATA
ATTTGACCAAGGCTGAACGGGGTGGCCTGAGCGAGTTAGATAAGGCAGGATTTATTAAACGCCAGTTAGTGGAGACT
CGTCAAATCACCAAACATGTCGCGCAGATTTTGGACAGCCGGATGAACACCAAGTACGATGAAAATGACAAACTGAT
CCGTGAGGTGAAAGTCATTACTCTGAAGTCCAAATTAGTTAGTGATTTCCGGAAGGACTTTCAATTCTACAAAGTCC
GTGAAATTAATAACTATCATCACGCACATGACGCGTACCTGAATGCAGTGGTTGGGACCGCCCTTATCAAGAAATAT
CCTAAGCTGGAGTCGGAGTTTGTCTATGGCGACTATAAGGTATACGATGTTCGCAAAATGATTGCGAAATCTGAGCA
GGAGATCGGTAAGGCAACCGCAAAATATTTCTTTTACTCAAACATTATGAATTTCTTTAAGACAGAAATCACTCTGG
CCAACGGGGAGATTCGCAAACGTCCGTTGATCGAAACAAACGGCGAGACTGGCGAAATTGTTTGGGACAAAGGGCGT
GATTTCGCGACGGTGCGCAAGGTACTGAGCATGCCTCAAGTCAATATTGTTAAGAAAACCGAAGTGCAGACGGGCGG
GTTTTCCAAGGAAAGCATCTTACCCAAACGTAATTCAGATAAACTTATTGCACGCAAAAAGGACTGGGATCCGAAAA
AGTATGGAGGCTTCGACAGTCCAACCGTAGCCTACTCTGTTCTCGTTGTAGCGAAAGTAGAAAAGGGTAAATCCAAG
AAACTGAAATCTGTCAAGGAGTTGCTTGGAATCACCATTATGGAGCGTAGCTCCTTCGAGAAGAACCCGATTGACTT
TCTGGAAGCCAAAGGATATAAAGAGGTCAAGAAAGATCTTATCATTAAGCTGCCTAAGTATTCACTCTTCGAGCTGG
AAAATGGTCGTAAACGCATGCTCGCTTCTGCCGGCGAGTTGCAGAAGGGCAATGAATTAGCACTTCCATCAAAGTAC
GTTAACTTCCTGTATTTGGCCAGCCATTACGAGAAACTGAAGGGGTCTCCAGAGGACAACGAACAGAAACAATTATT
TGTAGAGCAGCACAAGCATTATCTTGATGAAATCATTGAGCAAATTTCCGAATTCAGTAAACGCGTAATCCTGGCCG
ATGCAAACCTCGACAAGGTGCTGAGCGCTTACAATAAGCATCGCGACAAACCTATCCGTGAGCAGGCTGAAAATATC
ATTCACCTGTTCACATTAACGAACCTGGGCGCTCCGGCCGCTTTTAAATATTTCGACACGACAATCGACCGTAAGCG
CTATACCAGTACGAAAGAAGTGTTGGATGCGACCCTTATTCACCAGTCAATTACAGGATTATATGAGACCCGTATCG
ACCTTAGCCAATTAGGTGGGGATGCGCCAGCGCCTGCTCCTGCACCCGCTCCAGCTCCTGCCCCAGCTCCAGCGCCC
GCTCCTGCGCCAGCTCCTGCACCTGCTCCAGCGATGGTTAGCAAAGGTGAAGAACTGTTTACCGGCGTTGTGCCGAT
TCTGGTGGAACTGGATGGTGATGTGAATGGCCATAAATTTAGCGTTagcGGCGAAGGCGAAGGTGATGCGACCtatG
GTAAACTGACCCTGAAATTTATTTGCACCACCGGTAAACTGCCGGTTCCGTGGCCGACCCTGGTGACCACCCTGACC
TATGGCGTTCAGTGCTTTAGCCGCTATCCGGATCATATGAAAcagCATGATTTCTTTAAAAGCGCGATGCCGGAAGG
CTATGTGCAGGAACGTACCATTtttTTCAAAGATGATGGCaacTATAAAACCCGTGCGGAAGTTAAATTTGAAGGCG
ATACCCTGGTGAACCGCATTGAACTGAAAGGTATTGATTTTAAAGAAGATGGCAACATTCTGGGTCATAAACTGGAA
TATAATtacAACAGCCATAATGTGTATATTatgGCCGATAAACAGAAAAATGGCATCAAAgtgAACTTTAAAATCCG
TCACAACCattGAAGATGGTAGCGTGCAGCTGGCGGATCATTATCAGCAGAATACCCCGATTGGTGATGGCCCGGTGC
TGCTGCCGGATAATCATTATCTGAGCACCCAGAGCgcgCTGAGCAAAGATCCGAATGAAAACGTGATCATATGGTG
CTGCTGGAATTTGTTACCGCCGCGGGCATTACCctgGGTATGGATGAACTGTATAAA (Cas9-GSAGSAAGSGEF-mCherry chimera DNA sequence)

SEQ ID NO: 368

ATGGACAAAAAGTACTCTATTGGCCTGGATATCGGGACCAACAGCGTCGGGTGGGCTGTTATCACCGACGAGTATAA
AGTACCTTCGAAAAAGTTCAAAGTGCTGGGCAACACCGATCGCCATTCAATCAAAAAGAACTTGATTGGTGCGCTGT

-continued

```
TGTTTGACTCCGGGGAAACCGCCGAGGCGACTCGCCTTAAACGTACAGCACGTCGCCGGTACACTCGGCGTAAGAAT

CGCATTTGCTATTTGCAGGAAATCTTTAGCAACGAGATGGCAAAAGTCGATGACTCGTTTTTCCACCGCCTCGAGGA

AAGCTTTCTGGTGGAGGAAGACAAAAAGCATGAGCGTCACCCGATCTTCGGCAACATTGTCGATGAAGTAGCGTATC

ATGAAAAATACCCAACCATTTACCACTTACGCAAAAAGCTGGTGGACAGCACTGACAAAGCTGATTTGCGCCTTATC

TATTTAGCCCTGGCACATATGATTAAGTTTCGTGGTCACTTCCTGATCGAAGGAGACTTAAATCCCGACAACAGTGA

TGTTGATAAATTGTTTATTCAGCTTGTCCAAACTTACAATCAACTGTTCGAGGAAAACCCGATCAATGCCTCCGGTG

TGGATGCAAAAGCCATTTTAAGTGCACGCCTTAGCAAGTCCCGTCGCTTAGAAAACCTTATCGCGCAGCTGCCCGGC

GAGAAAAAGAATGGTTTGTTTGGGAACCTTATTGCCTTGAGCTTAGGCCTCACCCCGAATTTCAAAAGTAATTTCGA

TCTTGCAGAAGACGCCAAATTACAACTGTCGAAGGATACTTATGATGACGATCTCGATAATCTGTTAGCGCAGATTG

GTGACCAATACGCCGATCTTTTTCTGGCGGCTAAAAATCTGAGCGACGCCATCTTGCTTTCGGATATTCTCCGCGTT

AACACCGAAATCACGAAAGCGCCTCTTAGTGCCAGCATGATTAAACGTTATGATGAACACCACCAGGACCTGACCTT

ACTCAAAGCGTTGGTTCGCCAGCAACTGCCAGAGAAGTACAAAGAAATCTTCTTTGATCAGTCAAAGAATGGTTATG

CCGGCTATATTGACGGGGGTGCAAGCCAAGAGGAATTCTACAAATTTATCAAGCCTATTCTGGAGAAAATGGATGGC

ACCGAAGAGTTATTGGTGAAGCTTAACCGTGAAGACCTCCTGCGGAAACAGCGCACATTCGATAATGGTTCGATCCC

ACACCAAATCCATTTGGGGGAGTTACACGCTATTTTGCGTCGCCAGGAAGACTTTTACCCTTTCCTGAAGGATAACC

GGGAGAAAATTGAGAAGATCCTTACCTTTCGTATTCCGTATTACGTAGGCCCCTTAGCACGGGGTAATAGCCGTTTC

GCGTGGATGACACGGAAGTCGGAAGAGACGATCACCCCGTGGAACTTCGAAGAGGTAGTCGACAAGGGCGCATCAGC

GCAGTCTTTTATTGAACGTATGACGAATTTCGATAAAAACTTGCCCAATGAGAAGGTGCTTCCGAAACATTCCTTGT

TATATGAATATTTTACAGTTTACAACGAGCTGACCAAGGTTAAATACGTGACGGAAGGAATGCGCAAGCCCGCTTTT

CTTAGCGGTGAGCAAAAAAGGCGATCGTCGACCTGTTATTCAAAACGAATCGTAAGGTGACTGTAAAGCAACTCAA

AGAAGATTACTTCAAAAAGATTGAGTGCTTCGACAGCGTCGAAATCTCTGGGGTAGAGGATCGGTTTAACGCAAGTT

TAGGTACCTACCATGACCTGCTTAAAATCATTAAGGATAAAGACTTCTTAGATAATGAAGAGAACGAAGATATTCTC

GAGGACATCGTCTTGACGTTAACCTTATTTGAGGATCGTGAAATGATTGAGGAACGCCTCAAAACTTATGCCCACCT

GTTCGACGATAAGGTGATGAAGCAGCTGAAACGTCGGCGCTACACAGGATGGGGCCGCTTGAGTCGCAAACTTATTA

ACGGAATCCGTGACAAGCAATCCGGCAAAACGATTCTGGATTTCTTGAAGTCGGACGGATTTGCTAATCGCAACTTC

ATGCAGTTGATCCATGATGACTCCCTGACTTTTAAAGAGGATATTCAAAAGGCGCAGGTTAGTGGTCAAGGCGACAG

CTTACACGAACACATCGCAAATTTGGCTGGTTCGCCGGCCATTAAAAAGGGGATCCTCCAGACCGTGAAAGTTGTAG

ATGAGCTTGTTAAGGTCATGGGTCGTCATAAGCCCGAAAACATCGTGATTGAAATGGCGCGGGAGAATCAAACGACC

CAGAAAGGACAAAAGAATAGCCGTGAACGGATGAAGCGGATCGAGGAAGGCATTAAAGAGCTGGGGTCTCAAATCTT

GAAGGAACACCCTGTGGAGAACACTCAGCTCCAAAATGAAAAACTTTACCTGTACTATTTGCAGAACGGACGCGATA

TGTACGTGGACCAAGAGTTGGATATTAATCGGCTGAGTGACTACGACGTTGATCATATCGTCCCGCAGAGCTTCCTC

AAAGACGATTCTATTGACAATAAGGTACTGACGCGCTCTGATAAAAACCGTGGTAAGTCGGACAACGTGCCCTCCGA

AGAGGTTGTGAAAAAGATGAAAAATTATTGGCGCCAGCTTTTAAACGCGAAGCTGATCACACAACGTAAATTCGATA

ATTTGACCAAGGCTGAACGGGGTGGCCTGAGCGAGTTAGATAAGGCAGGATTTATTAAACGCCAGTTAGTGGAGACT

CGTCAAATCACCAAACATGTCGCGCAGATTTTGGACAGCCGGATGAACACCAAGTACGATGAAAATGACAAACTGAT

CCGTGAGGTGAAAGTCATTACTCTGAAGTCCAAATTAGTTAGTGATTTCCGGAAGGACTTTCAATTCTACAAAGTCC

GTGAAATTAATAACTATCATCACGCACATGACGCGTACCTGAATGCAGTGGTTGGGACCGCCCTTATCAAGAAATAT

CCTAAGCTGGAGTCGGAGTTTGTCTATGGCGACTATAAGGTATACGATGTTCGCAAAATGATTGCGAAATCTGAGCA

GGAGATCGGTAAGGCAACCGCAAAATATTTCTTTTACTCAAACATTATGAATTTCTTTAAGACAGAAATCACTCTGG

CCAACGGGGAGATTCGCAAACGTCCGTTGATCGAAACAAACGGCGAGACTGGCGAAATTGTTTGGGACAAAGGGCGT

GATTTCGCGACGGTGCGCAAGGTACTGAGCATGCCTCAAGTCAATATTGTTAAGAAAACCGAAGTGCAGACGGGCGG
```

```
GTTTTCCAAGGAAAGCATCTTACCCAAACGTAATTCAGATAAACTTATTGCACGCAAAAAGGACTGGGATCCGAAAA

AGTATGGAGGCTTCGACAGTCCAACCGTAGCCTACTCTGTTCTCGTTGTAGCGAAAGTAGAAAAGGGTAAATCCAAG

AAACTGAAATCTGTCAAGGAGTTGCTTGGAATCACCATTATGGAGCGTAGCTCCTTCGAGAAGAACCCGATTGACTT

TCTGGAAGCCAAAGGATATAAAGAGGTCAAGAAAGATCTTATCATTAAGCTGCCTAAGTATTCACTCTTCGAGCTGG

AAAATGGTCGTAAACGCATGCTCGCTTCTGCCGGCGAGTTGCAGAAGGGCAATGAATTAGCACTTCCATCAAAGTAC

GTTAACTTCCTGTATTTGGCCAGCCATTACGAGAAACTGAAGGGGTCTCCAGAGGACAACGAACAGAAACAATTATT

TGTAGAGCAGCACAAGCATTATCTTGATGAAATCATTGAGCAAATTTCCGAATTCAGTAAACGCGTAATCCTGGCCG

ATGCAAACCTCGACAAGGTGCTGAGCGCTTACAATAAGCATCGCGACAAACCTATCCGTGAGCAGGCTGAAAATATC

ATTCACCTGTTCACATTAACGAACCTGGGCGCTCCGGCCGCTTTTAAATATTTCGACACGACAATCGACCGTAAGCG

CTATACCAGTACGAAAGAAGTGTTGGATGCGACCCTTATTCACCAGTCAATTACAGGATTATATGAGACCCGTATCG

ACCTTAGCCAATTAGGTGGGGATGGTAGCGCAGGTAGTGCAGCAGGTAGCGGTGAATTTATGGTGAGCAAAGGTGAA

GAGGATAATATGGCCATCATCAAAGAATTCATGCGCTTCAAAGTTCATATGGAAGGTAGCGTTAATGGCCACGAATT

TGAAATTGAAGGTGAAGGCGAAGGTCGTCCGTATGAAGGCACCCAGACCGCAAAACTGAAAGTTACCAAAGGTGGTC

CGCTGCCGTTTGCATGGGATATTCTGAGTCCGCAGTTTATGTATGGTAGCAAAGCCTATGTTAAACATCCGGCAGAT

ATCCCGGATTATCTGAAACTGAGCTTTCCGGAAGGTTTTAAATGGGAACGTGTGATGAATTTTGAAGATGGTGGTGT

TGTTACCGTTACACAGGATAGCAGCCTGCAGGATGGTGAATTTATCTATAAAGTTAAACTGCGTGGCACGAATTTTC

CGAGTGATGGTCCGGTTATGCAGAAAAAAACCATGGGTTGGGAAGCAAGCAGCGAACGTATGTATCCGGAAGATGGC

GCACTGAAAGGTGAAATTAAACAGCGTCTGAAGCTGAAAGATGGCGGTCATTATGATGCAGAAGTTAAAACCACCTA

CAAAGCCAAAAAACCGGTTCAGCTGCCTGGTGCATATAACGTTAACATTAAACTGGATATCACCAGCCACAACGAGG

ATTATACCATTGTTGAACAGTATGAACGTGCAGAAGGTCGCCATAGTACCGGTGGTATGGATGAACTGTATAAA
```

(Cas9-(GGGGS)$_4$-mCherry chimera DNA sequence)

SEQ ID NO: 369

```
ATGGACAAAAAGTACTCTATTGGCCTGGATATCGGGACCAACAGCGTCGGGTGGGCTGTTATCACCGACGAGTATAA

AGTACCTTCGAAAAAGTTCAAAGTGCTGGGCAACACCGATCGCCATTCAATCAAAAAGAACTTGATTGGTGCGCTGT

TGTTTGACTCCGGGGAAACCGCCGAGGCGACTCGCCTTAAACGTACAGCACGTCGCCGGTACACTCGGCGTAAGAAT

CGCATTTGCTATTTGCAGGAAATCTTTAGCAACGAGATGGCAAAAGTCGATGACTCGTTTTTCCACCGCCTCGAGGA

AAGCTTTCTGGTGGAGGAAGACAAAAAGCATGAGCGTCACCCGATCTTCGGCAACATTGTCGATGAAGTAGCGTATC

ATGAAAAATACCCAACCATTTACCACTTACGCAAAAAGCTGGTGGACAGCACTGACAAAGCTGATTTGCGCCTTATC

TATTTAGCCCTGGCACATATGATTAAGTTTCGTGGTCACTTCCTGATCGAAGGAGACTTAAATCCCGACAACAGTGA

TGTTGATAAATTGTTTATTCAGCTTGTCCAAACTTACAATCAACTGTTCGAGGAAAACCCGATCAATGCCTCCGGTG

TGGATGCAAAAGCCATTTTAAGTGCACGCCTTAGCAAGTCCCGTCGCTTAGAAAACCTTATCGCGCAGCTGCCCGGC

GAGAAAAGAATGGTTTGTTTGGGAACCTTATTGCCTTGAGCTTAGGCCTCACCCCGAATTTCAAAAGTAATTTCGA

TCTTGCAGAAGACGCCAAATTACAACTGTCGAAGGATACTTATGATGACGATCTCGATAATCTGTTAGCGCAGATTG

GTGACCAATACGCCGATCTTTTTCTGGCGGCTAAAAATCTGAGCGACGCCATCTTGCTTTCGGATATTCTCCGCGTT

AACACCGAAATCACGAAAGCGCCTCTTAGTGCCAGCATGATTAAACGTTATGATGAACACCACCAGGACCTGACCTT

ACTCAAAGCGTTGGTTCGCCAGCAACTGCCAGAGAAGTACAAAGAAATCTTCTTTGATCAGTCAAAGAATGGTTATG

CCGGCTATATTGACGGGGGTGCAAGCCAAGAGGAATTCTACAAATTTATCAAGCCTATTCTGGAGAAAATGGATGGC

ACCGAAGAGTTATTGGTGAAGCTTAACCGTGAAGACCTCCTGCGGAAACAGCGCACATTCGATAATGGTTCGATCCC

ACACCAAATCCATTTGGGGGAGTTACACGCTATTTTGCGTCGCCAGGAAGACTTTTACCCTTTCCTGAAGGATAACC

GGGAGAAAATTGAGAAGATCCTTACCTTTCGTATTCCGTATTACGTAGGCCCCTTAGCACGGGGTAATAGCCGTTTC

GCGTGGATGACACGGAAGTCGGAAGAGACGATCACCCCGTGGAACTTCGAAGAGGTAGTCGACAAGGGCGCATCAGC
```

-continued

```
GCAGTCTTTTATTGAACGTATGACGAATTTCGATAAAAACTTGCCCAATGAGAAGGTGCTTCCGAAACATTCCTTGT
TATATGAATATTTTACAGTTTACAACGAGCTGACCAAGGTTAAATACGTGACGGAAGGAATGCGCAAGCCCGCTTTT
CTTAGCGGTGAGCAAAAAAGGCGATCGTCGACCTGTTATTCAAAACGAATCGTAAGGTGACTGTAAAGCAACTCAA
AGAAGATTACTTCAAAAAGATTGAGTGCTTCGACAGCGTCGAAATCTCTGGGGTAGAGGATCGGTTTAACGCAAGTT
TAGGTACCTACCATGACCTGCTTAAAATCATTAAGGATAAAGACTTCTTAGATAATGAAGAGAACGAAGATATTCTC
GAGGACATCGTCTTGACGTTAACCTTATTTGAGGATCGTGAAATGATTGAGGAACGCCTCAAAACTTATGCCCACCT
GTTCGACGATAAGGTGATGAAGCAGCTGAAACGTCGGCGCTACACAGGATGGGGCCGCTTGAGTCGCAAACTTATTA
ACGGAATCCGTGACAAGCAATCCGGCAAAACGATTCTGGATTTCTTGAAGTCGGACGGATTTGCTAATCGCAACTTC
ATGCAGTTGATCCATGATGACTCCCTGACTTTTAAAGAGGATATTCAAAAGGCGCAGGTTAGTGGTCAAGGCGACAG
CTTACACGAACACATCGCAAATTTGGCTGGTTCGCCGGCCATTAAAAAGGGGATCCTCCAGACCGTGAAAGTTGTAG
ATGAGCTTGTTAAGGTCATGGGTCGTCATAAGCCCGAAAACATCGTGATTGAAATGGCGCGGGAGAATCAAACGACC
CAGAAAGGACAAAAGAATAGCCGTGAACGGATGAAGCGGATCGAGGAAGGCATTAAAGAGCTGGGGTCTCAAATCTT
GAAGGAACACCCTGTGGAGAACACTCAGCTCCAAAATGAAAAACTTTACCTGTACTATTTGCAGAACGGACGCGATA
TGTACGTGGACCAAGAGTTGGATATTAATCGGCTGAGTGACTACGACGTTGATCATATCGTCCCGCAGAGCTTCCTC
AAAGACGATTCTATTGACAATAAGGTACTGACGCGCTCTGATAAAAACCGTGGTAAGTCGGACAACGTGCCCTCCGA
AGAGGTTGTGAAAAAGATGAAAAATTATTGGCGCCAGCTTTTAAACGCGAAGCTGATCACACAACGTAAATTCGATA
ATTTGACCAAGGCTGAACGGGGTGGCCTGAGCGAGTTAGATAAGGCAGGATTTATTAAACGCCAGTTAGTGGAGACT
CGTCAAATCACCAAACATGTCGCGCAGATTTTGGACAGCCGGATGAACACCAAGTACGATGAAAATGACAAACTGAT
CCGTGAGGTGAAAGTCATTACTCTGAAGTCCAAATTAGTTAGTGATTTCCGGAAGGACTTTCAATTCTACAAAGTCC
GTGAAATTAATAACTATCATCACGCACATGACGCGTACCTGAATGCAGTGGTTGGGACCGCCCTTATCAAGAAATAT
CCTAAGCTGGAGTCGGAGTTTGTCTATGGCGACTATAAGGTATACGATGTTCGCAAAATGATTGCGAAATCTGAGCA
GGAGATCGGTAAGGCAACCGCAAAATATTTCTTTTACTCAAACATTATGAATTTCTTTAAGACAGAAATCACTCTGG
CCAACGGGGAGATTCGCAAACGTCCGTTGATCGAAACAAACGGCGAGACTGGCGAAATTGTTTGGGACAAAGGGCGT
GATTTCGCGACGGTGCGCAAGGTACTGAGCATGCCTCAAGTCAATATTGTTAAGAAAACCGAAGTGCAGACGGGCGG
GTTTTCCAAGGAAAGCATCTTACCCAAACGTAATTCAGATAAACTTATTGCACGCAAAAAGGACTGGGATCCGAAAA
AGTATGGAGGCTTCGACAGTCCAACCGTAGCCTACTCTGTTCTCGTTGTAGCGAAAGTAGAAAAGGGTAAATCCAAG
AAACTGAAATCTGTCAAGGAGTTGCTTGGAATCACCATTATGGAGCGTAGCTCCTTCGAGAAGAACCCGATTGACTT
TCTGGAAGCCAAAGGATATAAAGAGGTCAAGAAAGATCTTATCATTAAGCTGCCTAAGTATTCACTCTTCGAGCTGG
AAAATGGTCGTAAACGCATGCTCGCTTCTGCCGGCGAGTTGCAGAAGGGCAATGAATTAGCACTTCCATCAAAGTAC
GTTAACTTCCTGTATTTGGCCAGCCATTACGAGAAACTGAAGGGGTCTCCAGAGGACAACGAACAGAAACAATTATT
TGTAGAGCAGCACAAGCATTATCTTGATGAAATCATTGAGCAAATTTCCGAATTCAGTAAACGCGTAATCCTGGCCG
ATGCAAACCTCGACAAGGTGCTGAGCGCTTACAATAAGCATCGCGACAAACCTATCCGTGAGCAGGCTGAAAATATC
ATTCACCTGTTCACATTAACGAACCTGGGCGCTCCGGCCGCTTTTAAATATTTCGACACGACAATCGACCGTAAGCG
CTATACCAGTACGAAAGAAGTGTTGGATGCGACCCTTATTCACCAGTCAATTACAGGATTATATGAGACCCGTATCG
ACCTTAGCCAATTAGGTGGGGATGGAGGCGGAGGATCAGGCGGTGGCGGAAGTGGTGGAGGTGGGTCGGAGGTGGT
GGTAGCATGGTGAGCAAAGGTGAAGAGGATAATATGGCCATCATCAAAGAATTCATGCGCTTCAAAGTTCATATGGA
AGGTAGCGTTAATGGCCACGAATTTGAAATTGAAGGTGAAGGCGAAGGTCGTCCGTATGAAGGCACCCAGACCGCAA
AACTGAAAGTTACCAAAGGTGGTCCGCTGCCGTTTGCATGGGATATTCTGAGTCCGCAGTTTATGTATGGTAGCAAA
GCCTATGTTAAACATCCGGCAGATATCCCGGATTATCTGAAACTGAGCTTTCCGGAAGGTTTTAAATGGGAACGTGT
GATGAATTTTGAAGATGGTGGTGTTGTTACCGTTACACAGGATAGCAGCCTGCAGGATGGTGAATTTATCTATAAAG
TTAAACTGCGTGGCACGAATTTTCCGAGTGATGGTCCGGTTATGCAGAAAAAAACCATGGGTTGGGAAGCAAGCAGC
```

GAACGTATGTATCCGGAAGATGGCGCACTGAAAGGTGAAATTAAACAGCGTCTGAAGCTGAAAGATGGCGGTCATTA

TGATGCAGAAGTTAAAACCACCTACAAAGCCAAAAAACCGGTTCAGCTGCCTGGTGCATATAACGTTAACATTAAAC

TGGATATCACCAGCCACAACGAGGATTATACCATTGTTGAACAGTATGAACGTGCAGAAGGTCGCCATAGTACCGGT

GGTATGGATGAACTGTATAAA (Cas9-GGGGSEAAAKGGGGS-mCherry chimera DNA sequence)

SEQ ID NO: 370

ATGGACAAAAAGTACTCTATTGGCCTGGATATCGGGACCAACAGCGTCGGGTGGGCTGTTATCACCGACGAGTATAA

AGTACCTTCGAAAAAGTTCAAAGTGCTGGGCAACACCGATCGCCATTCAATCAAAAAGAACTTGATTGGTGCGCTGT

TGTTTGACTCCGGGGAAACCGCCGAGGCGACTCGCCTTAAACGTACAGCACGTCGCCGGTACACTCGGCGTAAGAAT

CGCATTTGCTATTTGCAGGAAATCTTTAGCAACGAGATGGCAAAAGTCGATGACTCGTTTTTCCACCGCCTCGAGGA

AAGCTTTCTGGTGGAGGAAGACAAAAAGCATGAGCGTCACCCGATCTTCGGCAACATTGTCGATGAAGTAGCGTATC

ATGAAAAATACCCAACCATTTACCACTTACGCAAAAAGCTGGTGGACAGCACTGACAAAGCTGATTTGCGCCTTATC

TATTTAGCCCTGGCACATATGATTAAGTTTCGTGGTCACTTCCTGATCGAAGGAGACTTAAATCCCGACAACAGTGA

TGTTGATAAATTGTTTATTCAGCTTGTCCAAACTTACAATCAACTGTTCGAGGAAAACCCGATCAATGCCTCCGGTG

TGGATGCAAAAGCCATTTTAAGTGCACGCCTTAGCAAGTCCCGTCGCTTAGAAAACCTTATCGCGCAGCTGCCCGGC

GAGAAAAAGAATGGTTTGTTTGGGAACCTTATTGCCTTGAGCTTAGGCCTCACCCCGAATTTCAAAAGTAATTTCGA

TCTTGCAGAAGACGCCAAATTACAACTGTCGAAGGATACTTATGATGACGATCTCGATAATCTGTTAGCGCAGATTG

GTGACCAATACGCCGATCTTTTTCTGGCGGCTAAAAATCTGAGCGACGCCATCTTGCTTTCGGATATTCTCCGCGTT

AACACCGAAATCACGAAAGCGCCTCTTAGTGCCAGCATGATTAAACGTTATGATGAACACCACCAGGACCTGACCTT

ACTCAAAGCGTTGGTTCGCCAGCAACTGCCAGAGAAGTACAAAGAAATCTTCTTTGATCAGTCAAAGAATGGTTATG

CCGGCTATATTGACGGGGGTGCAAGCCAAGAGGAATTCTACAAATTTATCAAGCCTATTCTGGAGAAAATGGATGGC

ACCGAAGAGTTATTGGTGAAGCTTAACCGTGAAGACCTCCTGCGGAAACAGCGCACATTCGATAATGGTTCGATCCC

ACACCAAATCCATTTGGGGGAGTTACACGCTATTTTGCGTCGCCAGGAAGACTTTTACCCTTTCCTGAAGGATAACC

GGGAGAAAATTGAGAAGATCCTTACCTTTCGTATTCCGTATTACGTAGGCCCCTTAGCACGGGGTAATAGCCGTTTC

GCGTGGATGACACGGAAGTCGGAAGAGACGATCACCCCGTGGAACTTCGAAGAGGTAGTCGACAAGGGCGCATCAGC

GCAGTCTTTTATTGAACGTATGACGAATTTCGATAAAAACTTGCCCAATGAGAAGGTGCTTCCGAAACATTCCTTGT

TATATGAATATTTTACAGTTTACAACGAGCTGACCAAGGTTAAATACGTGACGGAAGGAATGCGCAAGCCCGCTTTT

CTTAGCGGTGAGCAAAAAAAGGCGATCGTCGACCTGTTATTCAAAACGAATCGTAAGGTGACTGTAAAGCAACTCAA

AGAAGATTACTTCAAAAAGATTGAGTGCTTCGACAGCGTCGAAATCTCTGGGGTAGAGGATCGGTTTAACGCAAGTT

TAGGTACCTACCATGACCTGCTTAAAATCATTAAGGATAAAGACTTCTTAGATAATGAAGAGAACGAAGATATTCTC

GAGGACATCGTCTTGACGTTAACCTTATTTGAGGATCGTGAAATGATTGAGGAACGCCTCAAAACTTATGCCCACCT

GTTCGACGATAAGGTGATGAAGCAGCTGAAACGTCGGCGCTACACAGGATGGGGCCGCTTGAGTCGCAAACTTATTA

ACGGAATCCGTGACAAGCAATCCGGCAAAACGATTCTGGATTTCTTGAAGTCGGACGGATTTGCTAATCGCAACTTC

ATGCAGTTGATCCATGATGACTCCCTGACTTTTAAAGAGGATATTCAAAAGGCGCAGGTTAGTGGTCAAGGCGACAG

CTTACACGAACACATCGCAAATTTGGCTGGTTCGCCGGCCATTAAAAAGGGGATCCTCCAGACCGTGAAAGTTGTAG

ATGAGCTTGTTAAGGTCATGGGTCGTCATAAGCCCGAAAACATCGTGATTGAAATGGCGCGGGAGAATCAAACGACC

CAGAAAGGACAAAAGAATAGCCGTGAACGGATGAAGCGGATCGAGGAAGGCATTAAAGAGCTGGGGTCTCAAATCTT

GAAGGAACACCCTGTGGAGAACACTCAGCTCCAAAATGAAAAACTTTACCTGTACTATTTGCAGAACGGACGCGATA

TGTACGTGGACCAAGAGTTGGATATTAATCGGCTGAGTGACTACGACGTTGATCATATCGTCCCGCAGAGCTTCCTC

AAAGACGATTCTATTGACAATAAGGTACTGACGCGCTCTGATAAAAACCGTGGTAAGTCGGACAACGTGCCCTCCGA

AGAGGTTGTGAAAAAGATGAAAAATTATTGGCGCCAGCTTTTAAACGCGAAGCTGATCACACAACGTAAATTCGATA

-continued

ATTTGACCAAGGCTGAACGGGGTGGCCTGAGCGAGTTAGATAAGGCAGGATTTATTAAACGCCAGTTAGTGGAGACT

CGTCAAATCACCAAACATGTCGCGCAGATTTTGGACAGCCGGATGAACACCAAGTACGATGAAAATGACAAACTGAT

CCGTGAGGTGAAAGTCATTACTCTGAAGTCCAAATTAGTTAGTGATTTCCGGAAGGACTTTCAATTCTACAAAGTCC

GTGAAATTAATAACTATCATCACGCACATGACGCGTACCTGAATGCAGTGGTTGGGACCGCCCTTATCAAGAAATAT

CCTAAGCTGGAGTCGGAGTTTGTCTATGGCGACTATAAGGTATACGATGTTCGCAAAATGATTGCGAAATCTGAGCA

GGAGATCGGTAAGGCAACCGCAAAATATTTCTTTTACTCAAACATTATGAATTTCTTTAAGACAGAAATCACTCTGG

CCAACGGGGAGATTCGCAAACGTCCGTTGATCGAAACAAACGGCGAGACTGGCGAAATTGTTTGGGACAAAGGGCGT

GATTTCGCGACGGTGCGCAAGGTACTGAGCATGCCTCAAGTCAATATTGTTAAGAAAACCGAAGTGCAGACGGGCGG

GTTTTCCAAGGAAAGCATCTTACCCAAACGTAATTCAGATAAACTTATTGCACGCAAAAAGGACTGGGATCCGAAAA

AGTATGGAGGCTTCGACAGTCCAACCGTAGCCTACTCTGTTCTCGTTGTAGCGAAAGTAGAAAAGGGTAAATCCAAG

AAACTGAAATCTGTCAAGGAGTTGCTTGGAATCACCATTATGGAGCGTAGCTCCTTCGAGAAGAACCCGATTGACTT

TCTGGAAGCCAAAGGATATAAAGAGGTCAAGAAAGATCTTATCATTAAGCTGCCTAAGTATTCACTCTTCGAGCTGG

AAAATGGTCGTAAACGCATGCTCGCTTCTGCCGGCGAGTTGCAGAAGGGCAATGAATTAGCACTTCCATCAAAGTAC

GTTAACTTCCTGTATTTGGCCAGCCATTACGAGAAACTGAAGGGGTCTCCAGAGGACAACGAACAGAAACAATTATT

TGTAGAGCAGCACAAGCATTATCTTGATGAAATCATTGAGCAAATTTCCGAATTCAGTAAACGCGTAATCCTGGCCG

ATGCAAACCTCGACAAGGTGCTGAGCGCTTACAATAAGCATCGCGACAAACCTATCCGTGAGCAGGCTGAAAATATC

ATTCACCTGTTCACATTAACGAACCTGGGCGCTCCGGCCGCTTTTAAATATTTCGACACGACAATCGACCGTAAGCG

CTATACCAGTACGAAAGAAGTGTTGGATGCGACCCTTATTCACCAGTCAATTACAGGATTATATGAGACCCGTATCG

ACCTTAGCCAATTAGGTGGGGATGGAGGCGGAGGGTCGGAAGCGGCAGCAAAAGGAGGCGGAGGAAGTATGGTGAGC

AAAGGTGAAGAGGATAATATGGCCATCATCAAAGAATTCATGCGCTTCAAAGTTCATATGGAAGGTAGCGTTAATGG

CCACGAATTTGAAATTGAAGGTGAAGGCGAAGGTCGTCCGTATGAAGGCACCCAGACCGCAAAACTGAAAGTTACCA

AAGGTGGTCCGCTGCCGTTTGCATGGGATATTCTGAGTCCGCAGTTTATGTATGGTAGCAAAGCCTATGTTAAACAT

CCGGCAGATATCCCGGATTATCTGAAACTGAGCTTTCCGGAAGGTTTTAAATGGGAACGTGTGATGAATTTTGAAGA

TGGTGGTGTTGTTACCGTTACACAGGATAGCAGCCTGCAGGATGGTGAATTTATCTATAAAGTTAAACTGCGTGGCA

CGAATTTTCCGAGTGATGGTCCGGTTATGCAGAAAAAAACCATGGGTTGGGAAGCAAGCAGCGAACGTATGTATCCG

GAAGATGGCGCACTGAAAGGTGAAATTAAACAGCGTCTGAAGCTGAAAGATGGCGGTCATTATGATGCAGAAGTTAA

AACCACCTACAAAGCCAAAAAACCGGTTCAGCTGCCTGGTGCATATAACGTTAACATTAAACTGGATATCACCAGCC

ACAACGAGGATTATACCATTGTTGAACAGTATGAACGTGCAGAAGGTCGCCATAGTACCGGTGGTATGGATGAACTG

TATAAA (Cas9-A(EAAAK)₄A-mCherry chimera DNA sequence)

SEQ ID NO: 371

ATGGACAAAAAGTACTCTATTGGCCTGGATATCGGGACCAACAGCGTCGGGTGGGCTGTTATCACCGACGAGTATAA

AGTACCTTCGAAAAAGTTCAAAGTGCTGGGCAACACCGATCGCCATTCAATCAAAAAGAACTTGATTGGTGCGCTGT

TGTTTGACTCCGGGGAAACCGCCGAGGCGACTCGCCTTAAACGTACAGCACGTCGCCGGTACACTCGGCGTAAGAAT

CGCATTTGCTATTTGCAGGAAATCTTTAGCAACGAGATGGCAAAAGTCGATGACTCGTTTTTCCACCGCCTCGAGGA

AAGCTTTCTGGTGGAGGAAGACAAAAAGCATGAGCGTCACCCGATCTTCGGCAACATTGTCGATGAAGTAGCGTATC

ATGAAAAATACCCAACCATTTACCACTTACGCAAAAAGCTGGTGGACAGCACTGACAAAGCTGATTTGCGCCTTATC

TATTTAGCCCTGGCACATATGATTAAGTTTCGTGGTCACTTCCTGATCGAAGGAGACTTAAATCCCGACAACAGTGA

TGTTGATAAATTGTTTATTCAGCTTGTCCAAACTTACAATCAACTGTTCGAGGAAAACCCGATCAATGCCTCCGGTG

TGGATGCAAAAGCCATTTTAAGTGCACGCCTTAGCAAGTCCCGTCGCTTAGAAAACCTTATCGCGCAGCTGCCCGGC

GAGAAAAAGAATGGTTTGTTTGGGAACCTTATTGCCTTGAGCTTAGGCCTCACCCCGAATTTCAAAAGTAATTTCGA

TCTTGCAGAAGACGCCAAATTACAACTGTCGAAGGATACTTATGATGACGATCTCGATAATCTGTTAGCGCAGATTG

-continued

```
GTGACCAATACGCCGATCTTTTTCTGGCGGCTAAAAATCTGAGCGACGCCATCTTGCTTTCGGATATTCTCCGCGTT

AACACCGAAATCACGAAAGCGCCTCTTAGTGCCAGCATGATTAAACGTTATGATGAACACCACCAGGACCTGACCTT

ACTCAAAGCGTTGGTTCGCCAGCAACTGCCAGAGAAGTACAAAGAAATCTTCTTTGATCAGTCAAAGAATGGTTATG

CCGGCTATATTGACGGGGGTGCAAGCCAAGAGGAATTCTACAAATTTATCAAGCCTATTCTGGAGAAAATGGATGGC

ACCGAAGAGTTATTGGTGAAGCTTAACCGTGAAGACCTCCTGCGGAAACAGCGCACATTCGATAATGGTTCGATCCC

ACACCAAATCCATTTGGGGGAGTTACACGCTATTTTGCGTCGCCAGGAAGACTTTTACCCTTTCCTGAAGGATAACC

GGGAGAAAATTGAGAAGATCCTTACCTTTCGTATTCCGTATTACGTAGGCCCCTTAGCACGGGGTAATAGCCGTTTC

GCGTGGATGACACGGAAGTCGGAAGAGACGATCACCCCGTGGAACTTCGAAGAGGTAGTCGACAAGGGCGCATCAGC

GCAGTCTTTTATTGAACGTATGACGAATTTCGATAAAAACTTGCCCAATGAGAAGGTGCTTCCGAAACATTCCTTGT

TATATGAATATTTTACAGTTTACAACGAGCTGACCAAGGTTAAATACGTGACGGAAGGAATGCGCAAGCCCGCTTTT

CTTAGCGGTGAGCAAAAAAGGCGATCGTCGACCTGTTATTCAAAACGAATCGTAAGGTGACTGTAAAGCAACTCAA

AGAAGATTACTTCAAAAAGATTGAGTGCTTCGACAGCGTCGAAATCTCTGGGGTAGAGGATCGGTTTAACGCAAGTT

TAGGTACCTACCATGACCTGCTTAAAATCATTAAGGATAAAGACTTCTTAGATAATGAAGAGAACGAAGATATTCTC

GAGGACATCGTCTTGACGTTAACCTTATTTGAGGATCGTGAAATGATTGAGGAACGCCTCAAAACTTATGCCCACCT

GTTCGACGATAAGGTGATGAAGCAGCTGAAACGTCGGCGCTACACAGGATGGGGCCGCTTGAGTCGCAAACTTATTA

ACGGAATCCGTGACAAGCAATCCGGCAAAACGATTCTGGATTTCTTGAAGTCGGACGGATTTGCTAATCGCAACTTC

ATGCAGTTGATCCATGATGACTCCCTGACTTTTAAAGAGGATATTCAAAAGGCGCAGGTTAGTGGTCAAGGCGACAG

CTTACACGAACACATCGCAAATTTGGCTGGTTCGCCGGCCATTAAAAAGGGGATCCTCCAGACCGTGAAAGTTGTAG

ATGAGCTTGTTAAGGTCATGGGTCGTCATAAGCCCGAAAACATCGTGATTGAAATGGCGCGGGAGAATCAAACGACC

CAGAAAGGACAAAAGAATAGCCGTGAACGGATGAAGCGGATCGAGGAAGGCATTAAAGAGCTGGGGTCTCAAATCTT

GAAGGAACACCCTGTGGAGAACACTCAGCTCCAAAATGAAAAACTTTACCTGTACTATTTGCAGAACGGACGCGATA

TGTACGTGGACCAAGAGTTGGATATTAATCGGCTGAGTGACTACGACGTTGATCATATCGTCCCGCAGAGCTTCCTC

AAAGACGATTCTATTGACAATAAGGTACTGACGCGCTCTGATAAAAACCGTGGTAAGTCGGACAACGTGCCCTCCGA

AGAGGTTGTGAAAAAGATGAAAAATTATTGGCGCCAGCTTTTAAACGCGAAGCTGATCACACAACGTAAATTCGATA

ATTTGACCAAGGCTGAACGGGGTGGCCTGAGCGAGTTAGATAAGGCAGGATTTATTAAACGCCAGTTAGTGGAGACT

CGTCAAATCACCAAACATGTCGCGCAGATTTTGGACAGCCGGATGAACACCAAGTACGATGAAAATGACAAACTGAT

CCGTGAGGTGAAAGTCATTACTCTGAAGTCCAAATTAGTTAGTGATTTCCGGAAGGACTTTCAATTCTACAAAGTCC

GTGAAATTAATAACTATCATCACGCACATGACGCGTACCTGAATGCAGTGGTTGGGACCGCCCTTATCAAGAAATAT

CCTAAGCTGGAGTCGGAGTTTGTCTATGGCGACTATAAGGTATACGATGTTCGCAAATGATTGCGAAATCTGAGCA

GGAGATCGGTAAGGCAACCGCAAAATATTTCTTTTACTCAAACATTATGAATTTCTTTAAGACAGAAATCACTCTGG

CCAACGGGGAGATTCGCAAACGTCCGTTGATCGAAACAAACGGCGAGACTGGCGAAATTGTTTGGGACAAAGGGCGT

GATTTCGCGACGGTGCGCAAGGTACTGAGCATGCCTCAAGTCAATATTGTTAAGAAAACCGAAGTGCAGACGGGCGG

GTTTTCCAAGGAAAGCATCTTACCCAAACGTAATTCAGATAAACTTATTGCACGCAAAAAGGACTGGGATCCGAAAA

AGTATGGAGGCTTCGACAGTCCAACCGTAGCCTACTCTGTTCTCGTTGTAGCGAAAGTAGAAAGGGTAAATCCAAG

AAACTGAAATCTGTCAAGGAGTTGCTTGGAATCACCATTATGGAGCGTAGCTCCTTCGAGAAGAACCCGATTGACTT

TCTGGAAGCCAAAGGATATAAAGAGGTCAAGAAAGATCTTATCATTAAGCTGCCTAAGTATTCACTCTTCGAGCTGG

AAAATGGTCGTAAACGCATGCTCGCTTCTGCCGGCGAGTTGCAGAAGGGCAATGAATTAGCACTTCCATCAAAGTAC

GTTAACTTCCTGTATTTGGCCAGCCATTACGAGAAACTGAAGGGGTCTCCAGAGGACAACGAACAGAAACAATTATT

TGTAGAGCAGCACAAGCATTATCTTGATGAAATCATTGAGCAAATTTCCGAATTCAGTAAACGCGTAATCCTGGCCG

ATGCAAACCTCGACAAGGTGCTGAGCGCTTACAATAAGCATCGCGACAAACCTATCCGTGAGCAGGCTGAAAATATC
```

-continued

ATTCACCTGTTCACATTAACGAACCTGGGCGCTCCGGCCGCTTTTAAATATTTCGACACGACAATCGACCGTAAGCG

CTATACCAGTACGAAAGAAGTGTTGGATGCGACCCTTATTCACCAGTCAATTACAGGATTATATGAGACCCGTATCG

ACCTTAGCCAATTAGGTGGGGATGCTGAGGCCGCAGCAAAAGAGGCTGCCGCTAAGGAGGCTGCTGCAAAAGAAGCA

GCAGCGAAAGCTATGGTGAGCAAAGGTGAAGAGGATAATATGGCCATCATCAAAGAATTCATGCGCTTCAAAGTTCA

TATGGAAGGTAGCGTTAATGGCCACGAATTTGAAATTGAAGGTGAAGGCGAAGGTCGTCCGTATGAAGGCACCCAGA

CCGCAAAACTGAAAGTTACCAAAGGTGGTCCGCTGCCGTTTGCATGGGATATTCTGAGTCCGCAGTTTATGTATGGT

AGCAAAGCCTATGTTAAACATCCGGCAGATATCCCGGATTATCTGAAACTGAGCTTTCCGGAAGGTTTTAAATGGGA

ACGTGTGATGAATTTTGAAGATGGTGGTGTTGTTACCGTTACACAGGATAGCAGCCTGCAGGATGGTGAATTTATCT

ATAAAGTTAAACTGCGTGGCACGAATTTTCCGAGTGATGGTCCGGTTATGCAGAAAAAAACCATGGGTTGGGAAGCA

AGCAGCGAACGTATGTATCCGGAAGATGGCGCACTGAAAGGTGAAATTAAACAGCGTCTGAAGCTGAAAGATGGCGG

TCATTATGATGCAGAAGTTAAAACCACCTACAAAGCCAAAAAACCGGTTCAGCTGCCTGGTGCATATAACGTTAACA

TTAAACTGGATATCACCAGCCACAACGAGGATTATACCATTGTTGAACAGTATGAACGTGCAGAAGGTCGCCATAGT

ACCGGTGGTATGGATGAACTGTATAAA (Cas9-A(EAAAK)4ALEA(EAAAK)4A-mCherry chimera DNA sequence)

SEQ ID NO: 372

ATGGACAAAAAGTACTCTATTGGCCTGGATATCGGGACCAACAGCGTCGGGTGGGCTGTTATCACCGACGAGTATAA

AGTACCTTCGAAAAAGTTCAAAGTGCTGGGCAACACCGATCGCCATTCAATCAAAAAGAACTTGATTGGTGCGCTGT

TGTTTGACTCCGGGGAAACCGCCGAGGCGACTCGCCTTAAACGTACAGCACGTCGCCGGTACACTCGGCGTAAGAAT

CGCATTTGCTATTTGCAGGAAATCTTTAGCAACGAGATGGCAAAAGTCGATGACTCGTTTTTCCACCGCCTCGAGGA

AAGCTTTCTGGTGGAGGAAGACAAAAAGCATGAGCGTCACCCGATCTTCGGCAACATTGTCGATGAAGTAGCGTATC

ATGAAAAATACCCAACCATTTACCACTTACGCAAAAAGCTGGTGGACAGCACTGACAAAGCTGATTTGCGCCTTATC

TATTTAGCCCTGGCACATATGATTAAGTTTCGTGGTCACTTCCTGATCGAAGGAGACTTAAATCCCGACAACAGTGA

TGTTGATAAATTGTTTATTCAGCTTGTCCAAACTTACAATCAACTGTTCGAGGAAAACCCGATCAATGCCTCCGGTG

TGGATGCAAAAGCCATTTTAAGTGCACGCCTTAGCAAGTCCCGTCGCTTAGAAAACCTTATCGCGCAGCTGCCCGGC

GAGAAAAAGAATGGTTTGTTTGGGAACCTTATTGCCTTGAGCTTAGGCCTCACCCCGAATTTCAAAAGTAATTTCGA

TCTTGCAGAAGACGCCAAATTACAACTGTCGAAGGATACTTATGATGACGATCTCGATAATCTGTTAGCGCAGATTG

GTGACCAATACGCCGATCTTTTTCTGGCGGCTAAAAATCTGAGCGACGCCATCTTGCTTTCGGATATTCTCCGCGTT

AACACCGAAATCACGAAAGCGCCTCTTAGTGCCAGCATGATTAAACGTTATGATGAACACCACCAGGACCTGACCTT

ACTCAAAGCGTTGGTTCGCCAGCAACTGCCAGAGAAGTACAAAGAAATCTTCTTTGATCAGTCAAAGAATGGTTATG

CCGGCTATATTGACGGGGGTGCAAGCCAAGAGGAATTCTACAAATTTATCAAGCCTATTCTGGAGAAAATGGATGGC

ACCGAAGAGTTATTGGTGAAGCTTAACCGTGAAGACCTCCTGCGGAAACAGCGCACATTCGATAATGGTTCGATCCC

ACACCAAATCCATTTGGGGGAGTTACACGCTATTTTGCGTCGCCAGGAAGACTTTTACCCTTTCCTGAAGGATAACC

GGGAGAAAATTGAGAAGATCCTTACCTTTCGTATTCCGTATTACGTAGGCCCCTTAGCACGGGGTAATAGCCGTTTC

GCGTGGATGACACGGAAGTCGGAAGAGACGATCACCCCGTGGAACTTCGAAGAGGTAGTCGACAAGGGCGCATCAGC

GCAGTCTTTTATTGAACGTATGACGAATTTCGATAAAAACTTGCCCAATGAGAAGGTGCTTCCGAAACATTCCTTGT

TATATGAATATTTTACAGTTTACAACGAGCTGACCAAGGTTAAATACGTGACGGAAGGAATGCGCAAGCCCGCTTTT

CTTAGCGGTGAGCAAAAAAAGGCGATCGTCGACCTGTTATTCAAAACGAATCGTAAGGTGACTGTAAAGCAACTCAA

AGAAGATTACTTCAAAAAGATTGAGTGCTTCGACAGCGTCGAAATCTCTGGGGTAGAGGATCGGTTTAACGCAAGTT

TAGGTACCTACCATGACCTGCTTAAAATCATTAAGGATAAAGACTTCTTAGATAATGAAGAGAACGAAGATATTCTC

GAGGACATCGTCTTGACGTTAACCTTATTTGAGGATCGTGAAATGATTGAGGAACGCCTCAAAACTTATGCCCACCT

GTTCGACGATAAGGTGATGAAGCAGCTGAAACGTCGGCGCTACACAGGATGGGGCCGCTTGAGTCGCAAACTTATTA

ACGGAATCCGTGACAAGCAATCCGGCAAAACGATTCTGGATTTCTTGAAGTCGGACGGATTTGCTAATCGCAACTTC

-continued

ATGCAGTTGATCCATGATGACTCCCTGACTTTTAAAGAGGATATTCAAAAGGCGCAGGTTAGTGGTCAAGGCGACAG

CTTACACGAACACATCGCAAATTTGGCTGGTTCGCCGGCCATTAAAAAGGGGATCCTCCAGACCGTGAAAGTTGTAG

ATGAGCTTGTTAAGGTCATGGGTCGTCATAAGCCCGAAAACATCGTGATTGAAATGGCGCGGGAGAATCAAACGACC

CAGAAAGGACAAAAGAATAGCCGTGAACGGATGAAGCGGATCGAGGAAGGCATTAAAGAGCTGGGGTCTCAAATCTT

GAAGGAACACCCTGTGGAGAACACTCAGCTCCAAAATGAAAAACTTTACCTGTACTATTTGCAGAACGGACGCGATA

TGTACGTGGACCAAGAGTTGGATATTAATCGGCTGAGTGACTACGACGTTGATCATATCGTCCCGCAGAGCTTCCTC

AAAGACGATTCTATTGACAATAAGGTACTGACGCGCTCTGATAAAAACCGTGGTAAGTCGGACAACGTGCCCTCCGA

AGAGGTTGTGAAAAAGATGAAAAATTATTGGCGCCAGCTTTTAAACGCGAAGCTGATCACACAACGTAAATTCGATA

ATTTGACCAAGGCTGAACGGGGTGGCCTGAGCGAGTTAGATAAGGCAGGATTTATTAAACGCCAGTTAGTGGAGACT

CGTCAAATCACCAAACATGTCGCGCAGATTTTGGACAGCCGGATGAACACCAAGTACGATGAAAATGACAAACTGAT

CCGTGAGGTGAAAGTCATTACTCTGAAGTCCAAATTAGTTAGTGATTTCCGGAAGGACTTTCAATTCTACAAAGTCC

GTGAAATTAATAACTATCATCACGCACATGACGCGTACCTGAATGCAGTGGTTGGGACCGCCCTTATCAAGAAATAT

CCTAAGCTGGAGTCGGAGTTTGTCTATGGCGACTATAAGGTATACGATGTTCGCAAAATGATTGCGAAATCTGAGCA

GGAGATCGGTAAGGCAACCGCAAAATATTTCTTTTACTCAAACATTATGAATTTCTTTAAGACAGAAATCACTCTGG

CCAACGGGGAGATTCGCAAACGTCCGTTGATCGAAACAAACGGCGAGACTGGCGAAATTGTTTGGGACAAAGGGCGT

GATTTCGCGACGGTGCGCAAGGTACTGAGCATGCCTCAAGTCAATATTGTTAAGAAAACCGAAGTGCAGACGGGCGG

GTTTTCCAAGGAAAGCATCTTACCCAAACGTAATTCAGATAAACTTATTGCACGCAAAAAGGACTGGGATCCGAAAA

AGTATGGAGGCTTCGACAGTCCAACCGTAGCCTACTCTGTTCTCGTTGTAGCGAAAGTAGAAAAGGGTAAATCCAAG

AAACTGAAATCTGTCAAGGAGTTGCTTGGAATCACCATTATGGAGCGTAGCTCCTTCGAGAAGAACCCGATTGACTT

TCTGGAAGCCAAAGGATATAAAGAGGTCAAGAAAGATCTTATCATTAAGCTGCCTAAGTATTCACTCTTCGAGCTGG

AAAATGGTCGTAAACGCATGCTCGCTTCTGCCGGCGAGTTGCAGAAGGGCAATGAATTAGCACTTCCATCAAAGTAC

GTTAACTTCCTGTATTTGGCCAGCCATTACGAGAAACTGAAGGGGTCTCCAGAGGACAACGAACAGAAACAATTATT

TGTAGAGCAGCACAAGCATTATCTTGATGAAATCATTGAGCAAATTTCCGAATTCAGTAAACGCGTAATCCTGGCCG

ATGCAAACCTCGACAAGGTGCTGAGCGCTTACAATAAGCATCGCGACAAACCTATCCGTGAGCAGGCTGAAAATATC

ATTCACCTGTTCACATTAACGAACCTGGGCGCTCCGGCCGCTTTTAAATATTTCGACACGACAATCGACCGTAAGCG

CTATACCAGTACGAAAGAAGTGTTGGATGCGACCCTTATTCACCAGTCAATTACAGGATTATATGAGACCCGTATCG

ACCTTAGCCAATTAGGTGGGGATGCCGAAGCAGCAGCCAAAGAAGCTGCCGCAAAGGAGGCGGCAGCTAAAGAAGCG

GCCGCTAAGGCATTGGAAGCGGAGGCGGCTGCCAAGGAGGCTGCGGCGAAAGAAGCTGCGGCAAAGAAGCGGCTGC

AAAAGCGATGGTGAGCAAAGGTGAAGAGGATAATATGGCCATCATCAAAGAATTCATGCGCTTCAAAGTTCATATGG

AAGGTAGCGTTAATGGCCACGAATTTGAAATTGAAGGTGAAGGCGAAGGTCGTCCGTATGAAGGCACCCAGACCGCA

AAACTGAAAGTTACCAAAGGTGGTCCGCTGCCGTTTGCATGGGATATTCTGAGTCCGCAGTTTATGTATGGTAGCAA

AGCCTATGTTAAACATCCGGCAGATATCCCGGATTATCTGAAACTGAGCTTTCCGGAAGGTTTTAAATGGGAACGTG

TGATGAATTTTGAAGATGGTGGTGTTGTTACCGTTACACAGGATAGCAGCCTGCAGGATGGTGAATTTATCTATAAA

GTTAAACTGCGTGGCACGAATTTTCCGAGTGATGGTCCGGTTATGCAGAAAAAAACCATGGGTTGGGAAGCAAGCAG

CGAACGTATGTATCCGGAAGATGGCGCACTGAAAGGTGAAATTAAACAGCGTCTGAAGCTGAAAGATGGCGGTCATT

ATGATGCAGAAGTTAAAACCACCTACAAAGCCAAAAAACCGGTTCAGCTGCCTGGTGCATATAACGTTAACATTAAA

CTGGATATCACCAGCCACAACGAGGATTATACCATTGTTGAACAGTATGAACGTGCAGAAGGTCGCCATAGTACCGG

TGGTATGGATGAACTGTATAAA (Cas9-LEA(EAAAK)₄ALEA(EAAAK)₄ALE-mCherry chimera DNA sequence)
SEQ ID NO: 373

ATGGACAAAAAGTACTCTATTGGCCTGGATATCGGGACCAACAGCGTCGGGTGGGCTGTTATCACCGACGAGTATAA

AGTACCTTCGAAAAAGTTCAAAGTGCTGGGCAACACCGATCGCCATTCAATCAAAAAGAACTTGATTGGTGCGCTGT

TGTTTGACTCCGGGGAAACCGCCGAGGCGACTCGCCTTAAACGTACAGCACGTCGCCGGTACACTCGGCGTAAGAAT

CGCATTTGCTATTTGCAGGAAATCTTTAGCAACGAGATGGCAAAAGTCGATGACTCGTTTTTCCACCGCCTCGAGGA

AAGCTTTCTGGTGGAGGAAGACAAAAAGCATGAGCGTCACCCGATCTTCGGCAACATTGTCGATGAAGTAGCGTATC

ATGAAAAATACCCAACCATTTACCACTTACGCAAAAAGCTGGTGGACAGCACTGACAAAGCTGATTTGCGCCTTATC

TATTTAGCCCTGGCACATATGATTAAGTTTCGTGGTCACTTCCTGATCGAAGGAGACTTAAATCCCGACAACAGTGA

TGTTGATAAATTGTTTATTCAGCTTGTCCAAACTTACAATCAACTGTTCGAGGAAAACCCGATCAATGCCTCCGGTG

TGGATGCAAAAGCCATTTTAAGTGCACGCCTTAGCAAGTCCCGTCGCTTAGAAAACCTTATCGCGCAGCTGCCCGGC

GAGAAAAAGAATGGTTTGTTTGGGAACCTTATTGCCTTGAGCTTAGGCCTCACCCCGAATTTCAAAAGTAATTTCGA

TCTTGCAGAAGACGCCAAATTACAACTGTCGAAGGATACTTATGATGACGATCTCGATAATCTGTTAGCGCAGATTG

GTGACCAATACGCCGATCTTTTTCTGGCGGCTAAAAATCTGAGCGACGCCATCTTGCTTTCGGATATTCTCCGCGTT

AACACCGAAATCACGAAAGCGCCTCTTAGTGCCAGCATGATTAAACGTTATGATGAACACCACCAGGACCTGACCTT

ACTCAAAGCGTTGGTTCGCCAGCAACTGCCAGAGAAGTACAAAGAAATCTTCTTTGATCAGTCAAAGAATGGTTATG

CCGGCTATATTGACGGGGGTGCAAGCCAAGAGGAATTCTACAAATTTATCAAGCCTATTCTGGAGAAAATGGATGGC

ACCGAAGAGTTATTGGTGAAGCTTAACCGTGAAGACCTCCTGCGGAAACAGCGCACATTCGATAATGGTTCGATCCC

ACACCAAATCCATTTGGGGGAGTTACACGCTATTTTGCGTCGCCAGGAAGACTTTTACCCTTTCCTGAAGGATAACC

GGGAGAAAATTGAGAAGATCCTTACCTTTCGTATTCCGTATTACGTAGGCCCCTTAGCACGGGGTAATAGCCGTTTC

GCGTGGATGACACGGAAGTCGGAAGAGACGATCACCCCGTGGAACTTCGAAGAGGTAGTCGACAAGGGCGCATCAGC

GCAGTCTTTTATTGAACGTATGACGAATTTCGATAAAAACTTGCCCAATGAGAAGGTGCTTCCGAAACATTCCTTGT

TATATGAATATTTTACAGTTTACAACGAGCTGACCAAGGTTAAATACGTGACGGAAGGAATGCGCAAGCCCGCTTTT

CTTAGCGGTGAGCAAAAAAGGCGATCGTCGACCTGTTATTCAAAACGAATCGTAAGGTGACTGTAAAGCAACTCAA

AGAAGATTACTTCAAAAAGATTGAGTGCTTCGACAGCGTCGAAATCTCTGGGGTAGAGGATCGGTTTAACGCAAGTT

TAGGTACCTACCATGACCTGCTTAAAATCATTAAGGATAAAGACTTCTTAGATAATGAAGAGAACGAAGATATTCTC

GAGGACATCGTCTTGACGTTAACCTTATTTGAGGATCGTGAAATGATTGAGGAACGCCTCAAAACTTATGCCCACCT

GTTCGACGATAAGGTGATGAAGCAGCTGAAACGTCGGCGCTACACAGGATGGGGCCGCTTGAGTCGCAAACTTATTA

ACGGAATCCGTGACAAGCAATCCGGCAAAACGATTCTGGATTTCTTGAAGTCGGACGGATTTGCTAATCGCAACTTC

ATGCAGTTGATCCATGATGACTCCCTGACTTTTAAAGAGGATATTCAAAAGGCGCAGGTTAGTGGTCAAGGCGACAG

CTTACACGAACACATCGCAAATTTGGCTGGTTCGCCGGCCATTAAAAAGGGGATCCTCCAGACCGTGAAAGTTGTAG

ATGAGCTTGTTAAGGTCATGGGTCGTCATAAGCCCGAAAACATCGTGATTGAAATGGCGCGGGAGAATCAAACGACC

CAGAAAGGACAAAAGAATAGCCGTGAACGGATGAAGCGGATCGAGGAAGGCATTAAAGAGCTGGGGTCTCAAATCTT

GAAGGAACACCCTGTGGAGAACACTCAGCTCCAAAATGAAAAACTTTACCTGTACTATTTGCAGAACGGACGCGATA

TGTACGTGGACCAAGAGTTGGATATTAATCGGCTGAGTGACTACGACGTTGATCATATCGTCCCGCAGAGCTTCCTC

AAAGACGATTCTATTGACAATAAGGTACTGACGCGCTCTGATAAAAACCGTGGTAAGTCGGACAACGTGCCCTCCGA

AGAGGTTGTGAAAAAGATGAAAAATTATTGGCGCCAGCTTTTAAACGCGAAGCTGATCACACAACGTAAATTCGATA

ATTTGACCAAGGCTGAACGGGGTGGCCTGAGCGAGTTAGATAAGGCAGGATTTATTAAACGCCAGTTAGTGGAGACT

CGTCAAATCACCAAACATGTCGCGCAGATTTTGGACAGCCGGATGAACACCAAGTACGATGAAAATGACAAACTGAT

CCGTGAGGTGAAAGTCATTACTCTGAAGTCCAAATTAGTTAGTGATTTCCGGAAGGACTTTCAATTCTACAAAGTCC

GTGAAATTAATAACTATCATCACGCACATGACGCGTACCTGAATGCAGTGGTTGGGACCGCCCTTATCAAGAAATAT

-continued

```
CCTAAGCTGGAGTCGGAGTTTGTCTATGGCGACTATAAGGTATACGATGTTCGCAAAATGATTGCGAAATCTGAGCA

GGAGATCGGTAAGGCAACCGCAAAATATTTCTTTTACTCAAACATTATGAATTTCTTTAAGACAGAAATCACTCTGG

CCAACGGGGAGATTCGCAAACGTCCGTTGATCGAAACAAACGGCGAGACTGGCGAAATTGTTTGGGACAAAGGGCGT

GATTTCGCGACGGTGCGCAAGGTACTGAGCATGCCTCAAGTCAATATTGTTAAGAAAACCGAAGTGCAGACGGGCGG

GTTTTCCAAGGAAAGCATCTTACCCAAACGTAATTCAGATAAACTTATTGCACGCAAAAAGGACTGGGATCCGAAAA

AGTATGGAGGCTTCGACAGTCCAACCGTAGCCTACTCTGTTCTCGTTGTAGCGAAAGTAGAAAAGGGTAAATCCAAG

AAACTGAAATCTGTCAAGGAGTTGCTTGGAATCACCATTATGGAGCGTAGCTCCTTCGAGAAGAACCCGATTGACTT

TCTGGAAGCCAAAGGATATAAAGAGGTCAAGAAAGATCTTATCATTAAGCTGCCTAAGTATTCACTCTTCGAGCTGG

AAAATGGTCGTAAACGCATGCTCGCTTCTGCCGGCGAGTTGCAGAAGGGCAATGAATTAGCACTTCCATCAAAGTAC

GTTAACTTCCTGTATTTGGCCAGCCATTACGAGAAACTGAAGGGGTCTCCAGAGGACAACGAACAGAAACAATTATT

TGTAGAGCAGCACAAGCATTATCTTGATGAAATCATTGAGCAAATTTCCGAATTCAGTAAACGCGTAATCCTGGCCG

ATGCAAACCTCGACAAGGTGCTGAGCGCTTACAATAAGCATCGCGACAAACCTATCCGTGAGCAGGCTGAAAATATC

ATTCACCTGTTCACATTAACGAACCTGGGCGCTCCGGCCGCTTTTAAATATTTCGACACGACAATCGACCGTAAGCG

CTATACCAGTACGAAAGAAGTGTTGGATGCGACCCTTATTCACCAGTCAATTACAGGATTATATGAGACCCGTATCG

ACCTTAGCCAATTAGGTGGGGATTTAGAGGCTGAGGCTGCTGCCAAGGAGGCTGCTGCGAAGGAAGCTGCAGCTAAA

GAGGCAGCGGCCAAAGCACTTGAGGCCGAAGCCGCCGCGAAAGAAGCCGCTGCTAAGGAGGCAGCCGCCAAAGAAGC

GGCAGCTAAAGCATTAGAAATGGTGAGCAAAGGTGAAGAGGATAATATGGCCATCATCAAAGAATTCATGCGCTTCA

AAGTTCATATGGAAGGTAGCGTTAATGGCCACGAATTTGAAATTGAAGGTGAAGGCGAAGGTCGTCCGTATGAAGGC

ACCCAGACCGCAAAACTGAAAGTTACCAAAGGTGGTCCGCTGCCGTTTGCATGGGATATTCTGAGTCCGCAGTTTAT

GTATGGTAGCAAAGCCTATGTTAAACATCCGGCAGATATCCCGGATTATCTGAAACTGAGCTTTCCGGAAGGTTTTA

AATGGGAACGTGTGATGAATTTTGAAGATGGTGGTGTTGTTACCGTTACACAGGATAGCAGCCTGCAGGATGGTGAA

TTTATCTATAAAGTTAAACTGCGTGGCACGAATTTTCCGAGTGATGGTCCGGTTATGCAGAAAAAAACCATGGGTTG

GGAAGCAAGCAGCGAACGTATGTATCCGGAAGATGGCGCACTGAAAGGTGAAATTAAACAGCGTCTGAAGCTGAAAG

ATGGCGGTCATTATGATGCAGAAGTTAAAACCACCTACAAAGCCAAAAAACCGGTTCAGCTGCCTGGTGCATATAAC

GTTAACATTAAACTGGATATCACCAGCCACAACGAGGATTATACCATTGTTGAACAGTATGAACGTGCAGAAGGTCG

CCATAGTACCGGTGGTATGGATGAACTGTATAAA
```

(Cas9-APA-mCherry chimera DNA sequence)

SEQ ID NO: 374

```
ATGGACAAAAAGTACTCTATTGGCCTGGATATCGGGACCAACAGCGTCGGGTGGGCTGTTATCACCGACGAGTATAA

AGTACCTTCGAAAAAGTTCAAAGTGCTGGGCAACACCGATCGCCATTCAATCAAAAAGAACTTGATTGGTGCGCTGT

TGTTTGACTCCGGGGAAACCGCCGAGGCGACTCGCCTTAAACGTACAGCACGTCGCCGGTACACTCGGCGTAAGAAT

CGCATTTGCTATTTGCAGGAAATCTTTAGCAACGAGATGGCAAAAGTCGATGACTCGTTTTTCCACCGCCTCGAGGA

AAGCTTTCTGGTGGAGGAAGACAAAAAGCATGAGCGTCACCCGATCTTCGGCAACATTGTCGATGAAGTAGCGTATC

ATGAAAAATACCCAACCATTTACCACTTACGCAAAAAGCTGGTGGACAGCACTGACAAAGCTGATTTGCGCCTTATC

TATTTAGCCCTGGCACATATGATTAAGTTTCGTGGTCACTTCCTGATCGAAGGAGACTTAAATCCCGACAACAGTGA

TGTTGATAAATTGTTTATTCAGCTTGTCCAAACTTACAATCAACTGTTCGAGGAAAACCCGATCAATGCCTCCGGTG

TGGATGCAAAAGCCATTTTAAGTGCACGCCTTAGCAAGTCCCGTCGCTTAGAAAACCTTATCGCGCAGCTGCCCGGC

GAGAAAAAGAATGGTTTGTTTGGGAACCTTATTGCCTTGAGCTTAGGCCTCACCCCGAATTTCAAAAGTAATTTCGA

TCTTGCAGAAGACGCCAAATTACAACTGTCGAAGGATACTTATGATGACGATCTCGATAATCTGTTAGCGCAGATTG

GTGACCAATACGCCGATCTTTTTCTGGCGGCTAAAAATCTGAGCGACGCCATCTTGCTTTCGGATATTCTCCGCGTT

AACACCGAAATCACGAAAGCGCCTCTTAGTGCCAGCATGATTAAACGTTATGATGAACACCACCAGGACCTGACCTT

ACTCAAAGCGTTGGTTCGCCAGCAACTGCCAGAGAAGTACAAAGAAATCTTCTTTGATCAGTCAAAGAATGGTTATG
```

-continued

```
CCGGCTATATTGACGGGGGTGCAAGCCAAGAGGAATTCTACAAATTTATCAAGCCTATTCTGGAGAAAATGGATGGC
ACCGAAGAGTTATTGGTGAAGCTTAACCGTGAAGACCTCCTGCGGAAACAGCGCACATTCGATAATGGTTCGATCCC
ACACCAAATCCATTTGGGGGAGTTACACGCTATTTTGCGTCGCCAGGAAGACTTTTACCCTTTCCTGAAGGATAACC
GGGAGAAAATTGAGAAGATCCTTACCTTTCGTATTCCGTATTACGTAGGCCCCTTAGCACGGGGTAATAGCCGTTTC
GCGTGGATGACACGGAAGTCGGAAGAGACGATCACCCCGTGGAACTTCGAAGAGGTAGTCGACAAGGGCGCATCAGC
GCAGTCTTTTATTGAACGTATGACGAATTTCGATAAAAACTTGCCCAATGAGAAGGTGCTTCCGAAACATTCCTTGT
TATATGAATATTTTACAGTTTACAACGAGCTGACCAAGGTTAAATACGTGACGGAAGGAATGCGCAAGCCCGCTTTT
CTTAGCGGTGAGCAAAAAAGGCGATCGTCGACCTGTTATTCAAAACGAATCGTAAGGTGACTGTAAAGCAACTCAA
AGAAGATTACTTCAAAAAGATTGAGTGCTTCGACAGCGTCGAAATCTCTGGGGTAGAGGATCGGTTTAACGCAAGTT
TAGGTACCTACCATGACCTGCTTAAAATCATTAAGGATAAAGACTTCTTAGATAATGAAGAGAACGAAGATATTCTC
GAGGACATCGTCTTGACGTTAACCTTATTTGAGGATCGTGAAATGATTGAGGAACGCCTCAAAACTTATGCCCACCT
GTTCGACGATAAGGTGATGAAGCAGCTGAAACGTCGGCGCTACACAGGATGGGGCCGCTTGAGTCGCAAACTTATTA
ACGGAATCCGTGACAAGCAATCCGGCAAAACGATTCTGGATTTCTTGAAGTCGGACGGATTTGCTAATCGCAACTTC
ATGCAGTTGATCCATGATGACTCCCTGACTTTTAAAGAGGATATTCAAAAGGCGCAGGTTAGTGGTCAAGGCGACAG
CTTACACGAACACATCGCAAATTTGGCTGGTTCGCCGGCCATTAAAAAGGGGATCCTCCAGACCGTGAAAGTTGTAG
ATGAGCTTGTTAAGGTCATGGGTCGTCATAAGCCCGAAAACATCGTGATTGAAATGGCGCGGGAGAATCAAACGACC
CAGAAAGGACAAAAGAATAGCCGTGAACGGATGAAGCGGATCGAGGAAGGCATTAAAGAGCTGGGGTCTCAAATCTT
GAAGGAACACCCTGTGGAGAACACTCAGCTCCAAAATGAAAAACTTTACCTGTACTATTTGCAGAACGGACGCGATA
TGTACGTGGACCAAGAGTTGGATATTAATCGGCTGAGTGACTACGACGTTGATCATATCGTCCCGCAGAGCTTCCTC
AAAGACGATTCTATTGACAATAAGGTACTGACGCGCTCTGATAAAAACCGTGGTAAGTCGGACAACGTGCCCTCCGA
AGAGGTTGTGAAAAAGATGAAAAATTATTGGCGCCAGCTTTTAAACGCGAAGCTGATCACACAACGTAAATTCGATA
ATTTGACCAAGGCTGAACGGGGTGGCCTGAGCGAGTTAGATAAGGCAGGATTTATTAAACGCCAGTTAGTGGAGACT
CGTCAAATCACCAAACATGTCGCGCAGATTTTGGACAGCCGGATGAACACCAAGTACGATGAAAATGACAAACTGAT
CCGTGAGGTGAAAGTCATTACTCTGAAGTCCAAATTAGTTAGTGATTTCCGGAAGGACTTTCAATTCTACAAAGTCC
GTGAAATTAATAACTATCATCACGCACATGACGCGTACCTGAATGCAGTGGTTGGGACCGCCCTTATCAAGAAATAT
CCTAAGCTGGAGTCGGAGTTTGTCTATGGCGACTATAAGGTATACGATGTTCGCAAAATGATTGCGAAATCTGAGCA
GGAGATCGGTAAGGCAACCGCAAAATATTTCTTTTACTCAAACATTATGAATTTCTTTAAGACAGAAATCACTCTGG
CCAACGGGGAGATTCGCAAACGTCCGTTGATCGAAACAAACGGCGAGACTGGCGAAATTGTTTGGGACAAAGGGCGT
GATTTCGCGACGGTGCGCAAGGTACTGAGCATGCCTCAAGTCAATATTGTTAAGAAAACCGAAGTGCAGACGGGCGG
GTTTTCCAAGGAAAGCATCTTACCCAAACGTAATTCAGATAAACTTATTGCACGCAAAAAGGACTGGGATCCGAAAA
AGTATGGAGGCTTCGACAGTCCAACCGTAGCCTACTCTGTTCTCGTTGTAGCGAAAGTAGAAAAGGGTAAATCCAAG
AAACTGAAATCTGTCAAGGAGTTGCTTGGAATCACCATTATGGAGCGTAGCTCCTTCGAGAAGAACCCGATTGACTT
TCTGGAAGCCAAAGGATATAAAGAGGTCAAGAAAGATCTTATCATTAAGCTGCCTAAGTATTCACTCTTCGAGCTGG
AAAATGGTCGTAAACGCATGCTCGCTTCTGCCGGCGAGTTGCAGAAGGGCAATGAATTAGCACTTCCATCAAAGTAC
GTTAACTTCCTGTATTTGGCCAGCCATTACGAGAAACTGAAGGGGTCTCCAGAGGACAACGAACAGAAACAATTATT
TGTAGAGCAGCACAAGCATTATCTTGATGAAATCATTGAGCAAATTTCCGAATTCAGTAAACGCGTAATCCTGGCCG
ATGCAAACCTCGACAAGGTGCTGAGCGCTTACAATAAGCATCGCGACAAACCTATCCGTGAGCAGGCTGAAAATATC
ATTCACCTGTTCACATTAACGAACCTGGGCGCTCCGGCCGCTTTTAAATATTTCGACACGACAATCGACCGTAAGCG
CTATACCAGTACGAAAGAAGTGTTGGATGCGACCCTTATTCACCAGTCAATTACAGGATTATATGAGACCCGTATCG
ACCTTAGCCAATTAGGTGGGGATGCACCTGCGATGGTGAGCAAAGGTGAAGAGGATAATATGGCCATCATCAAAGAA
```

-continued

TTCATGCGCTTCAAAGTTCATATGGAAGGTAGCGTTAATGGCCACGAATTTGAAATTGAAGGTGAAGGCGAAGGTCG

TCCGTATGAAGGCACCCAGACCGCAAAACTGAAAGTTACCAAAGGTGGTCCGCTGCCGTTTGCATGGGATATTCTGA

GTCCGCAGTTTATGTATGGTAGCAAAGCCTATGTTAAACATCCGGCAGATATCCCGGATTATCTGAAACTGAGCTTT

CCGGAAGGTTTTAAATGGGAACGTGTGATGAATTTTGAAGATGGTGGTGTTGTTACCGTTACACAGGATAGCAGCCT

GCAGGATGGTGAATTTATCTATAAAGTTAAACTGCGTGGCACGAATTTTCCGAGTGATGGTCCGGTTATGCAGAAAA

AAACCATGGGTTGGGAAGCAAGCAGCGAACGTATGTATCCGGAAGATGGCGCACTGAAAGGTGAAATTAAACAGCGT

CTGAAGCTGAAAGATGGCGGTCATTATGATGCAGAAGTTAAAACCACCTACAAAGCCAAAAAACCGGTTCAGCTGCC

TGGTGCATATAACGTTAACATTAAACTGGATATCACCAGCCACAACGAGGATTATACCATTGTTGAACAGTATGAAC

GTGCAGAAGGTCGCCATAGTACCGGTGGTATGGATGAACTGTATAAA (Cas9-APAPA-mCherry chimera DNA sequence)

SEQ ID NO: 375

ATGGACAAAAAGTACTCTATTGGCCTGGATATCGGGACCAACAGCGTCGGGTGGGCTGTTATCACCGACGAGTATAA

AGTACCTTCGAAAAAGTTCAAAGTGCTGGGCAACACCGATCGCCATTCAATCAAAAAGAACTTGATTGGTGCGCTGT

TGTTTGACTCCGGGGAAACCGCCGAGGCGACTCGCCTTAAACGTACAGCACGTCGCCGGTACACTCGGCGTAAGAAT

CGCATTTGCTATTTGCAGGAAATCTTTAGCAACGAGATGGCAAAAGTCGATGACTCGTTTTTCCACCGCCTCGAGGA

AAGCTTTCTGGTGGAGGAAGACAAAAAGCATGAGCGTCACCCGATCTTCGGCAACATTGTCGATGAAGTAGCGTATC

ATGAAAAATACCCAACCATTTACCACTTACGCAAAAAGCTGGTGGACAGCACTGACAAAGCTGATTTGCGCCTTATC

TATTTAGCCCTGGCACATATGATTAAGTTTCGTGGTCACTTCCTGATCGAAGGAGACTTAAATCCCGACAACAGTGA

TGTTGATAAATTGTTTATTCAGCTTGTCCAAACTTACAATCAACTGTTCGAGGAAAACCCGATCAATGCCTCCGGTG

TGGATGCAAAAGCCATTTTAAGTGCACGCCTTAGCAAGTCCCGTCGCTTAGAAAACCTTATCGCGCAGCTGCCCGGC

GAGAAAAAGAATGGTTTGTTTGGGAACCTTATTGCCTTGAGCTTAGGCCTCACCCCGAATTTCAAAAGTAATTTCGA

TCTTGCAGAAGACGCCAAATTACAACTGTCGAAGGATACTTATGATGACGATCTCGATAATCTGTTAGCGCAGATTG

GTGACCAATACGCCGATCTTTTTCTGGCGGCTAAAAATCTGAGCGACGCCATCTTGCTTTCGGATATTCTCCGCGTT

AACACCGAAATCACGAAAGCGCCTCTTAGTGCCAGCATGATTAAACGTTATGATGAACACCACCAGGACCTGACCTT

ACTCAAAGCGTTGGTTCGCCAGCAACTGCCAGAGAAGTACAAAGAAATCTTCTTTGATCAGTCAAAGAATGGTTATG

CCGGCTATATTGACGGGGGTGCAAGCCAAGAGGAATTCTACAAATTTATCAAGCCTATTCTGGAGAAAATGGATGGC

ACCGAAGAGTTATTGGTGAAGCTTAACCGTGAAGACCTCCTGCGGAAACAGCGCACATTCGATAATGGTTCGATCCC

ACACCAAATCCATTTGGGGGAGTTACACGCTATTTTGCGTCGCCAGGAAGACTTTTACCCTTTCCTGAAGGATAACC

GGGAGAAAATTGAGAAGATCCTTACCTTTCGTATTCCGTATTACGTAGGCCCCTTAGCACGGGGTAATAGCCGTTTC

GCGTGGATGACACGGAAGTCGGAAGAGACGATCACCCCGTGGAACTTCGAAGAGGTAGTCGACAAGGGCGCATCAGC

GCAGTCTTTTATTGAACGTATGACGAATTTCGATAAAAACTTGCCCAATGAGAAGGTGCTTCCGAAACATTCCTTGT

TATATGAATATTTTACAGTTTACAACGAGCTGACCAAGGTTAAATACGTGACGGAAGGAATGCGCAAGCCCGCTTTT

CTTAGCGGTGAGCAAAAAAAGGCGATCGTCGACCTGTTATTCAAAACGAATCGTAAGGTGACTGTAAAGCAACTCAA

AGAAGATTACTTCAAAAAGATTGAGTGCTTCGACAGCGTCGAAATCTCTGGGGTAGAGGATCGGTTTAACGCAAGTT

TAGGTACCTACCATGACCTGCTTAAAATCATTAAGGATAAAGACTTCTTAGATAATGAAGAGAACGAAGATATTCTC

GAGGACATCGTCTTGACGTTAACCTTATTTGAGGATCGTGAAATGATTGAGGAACGCCTCAAAACTTATGCCCACCT

GTTCGACGATAAGGTGATGAAGCAGCTGAAACGTCGGCGCTACACAGGATGGGGCCGCTTGAGTCGCAAACTTATTA

ACGGAATCCGTGACAAGCAATCCGGCAAAACGATTCTGGATTTCTTGAAGTCGGACGGATTTGCTAATCGCAACTTC

ATGCAGTTGATCCATGATGACTCCCTGACTTTTAAAGAGGATATTCAAAAGGCGCAGGTTAGTGGTCAAGGCGACAG

CTTACACGAACACATCGCAAATTTGGCTGGTTCGCCGGCCATTAAAAAGGGGATCCTCCAGACCGTGAAAGTTGTAG

ATGAGCTTGTTAAGGTCATGGGTCGTCATAAGCCCGAAAACATCGTGATTGAAATGGCGCGGGAGAATCAAACGACC

CAGAAAGGACAAAAGAATAGCCGTGAACGGATGAAGCGGATCGAGGAAGGCATTAAAGAGCTGGGGTCTCAAATCTT

-continued

```
GAAGGAACACCCTGTGGAGAACACTCAGCTCCAAAATGAAAAACTTTACCTGTACTATTTGCAGAACGGACGCGATA
TGTACGTGGACCAAGAGTTGGATATTAATCGGCTGAGTGACTACGACGTTGATCATATCGTCCCGCAGAGCTTCCTC
AAAGACGATTCTATTGACAATAAGGTACTGACGCGCTCTGATAAAAACCGTGGTAAGTCGGACAACGTGCCCTCCGA
AGAGGTTGTGAAAAAGATGAAAAATTATTGGCGCCAGCTTTTAAACGCGAAGCTGATCACACAACGTAAATTCGATA
ATTTGACCAAGGCTGAACGGGGTGGCCTGAGCGAGTTAGATAAGGCAGGATTTATTAAACGCCAGTTAGTGGAGACT
CGTCAAATCACCAAACATGTCGCGCAGATTTTGGACAGCCGGATGAACACCAAGTACGATGAAAATGACAAACTGAT
CCGTGAGGTGAAAGTCATTACTCTGAAGTCCAAATTAGTTAGTGATTTCCGGAAGGACTTTCAATTCTACAAAGTCC
GTGAAATTAATAACTATCATCACGCACATGACGCGTACCTGAATGCAGTGGTTGGGACCGCCCTTATCAAGAAATAT
CCTAAGCTGGAGTCGGAGTTTGTCTATGGCGACTATAAGGTATACGATGTTCGCAAAATGATTGCGAAATCTGAGCA
GGAGATCGGTAAGGCAACCGCAAAATATTTCTTTTACTCAAACATTATGAATTTCTTTAAGACAGAAATCACTCTGG
CCAACGGGGAGATTCGCAAACGTCCGTTGATCGAAACAAACGGCGAGACTGGCGAAATTGTTTGGGACAAAGGGCGT
GATTTCGCGACGGTGCGCAAGGTACTGAGCATGCCTCAAGTCAATATTGTTAAGAAAACCGAAGTGCAGACGGGCGG
GTTTTCCAAGGAAAGCATCTTACCCAAACGTAATTCAGATAAACTTATTGCACGCAAAAAGGACTGGGATCCGAAAA
AGTATGGAGGCTTCGACAGTCCAACCGTAGCCTACTCTGTTCTCGTTGTAGCGAAAGTAGAAAAGGGTAAATCCAAG
AAACTGAAATCTGTCAAGGAGTTGCTTGGAATCACCATTATGGAGCGTAGCTCCTTCGAGAAGAACCCGATTGACTT
TCTGGAAGCCAAAGGATATAAAGAGGTCAAGAAAGATCTTATCATTAAGCTGCCTAAGTATTCACTCTTCGAGCTGG
AAAATGGTCGTAAACGCATGCTCGCTTCTGCCGGCGAGTTGCAGAAGGGCAATGAATTAGCACTTCCATCAAAGTAC
GTTAACTTCCTGTATTTGGCCAGCCATTACGAGAAACTGAAGGGGTCTCCAGAGGACAACGAACAGAAACAATTATT
TGTAGAGCAGCACAAGCATTATCTTGATGAAATCATTGAGCAAATTTCCGAATTCAGTAAACGCGTAATCCTGGCCG
ATGCAAACCTCGACAAGGTGCTGAGCGCTTACAATAAGCATCGCGACAAACCTATCCGTGAGCAGGCTGAAAATATC
ATTCACCTGTTCACATTAACGAACCTGGGCGCTCCGGCCGCTTTTAAATATTTCGACACGACAATCGACCGTAAGCG
CTATACCAGTACGAAAGAAGTGTTGGATGCGACCCTTATTCACCAGTCAATTACAGGATTATATGAGACCCGTATCG
ACCTTAGCCAATTAGGTGGGGATGCTCCTGCACCTGCGATGGTGAGCAAAGGTGAAGAGGATAATATGGCCATCATC
AAAGAATTCATGCGCTTCAAAGTTCATATGGAAGGTAGCGTTAATGGCCACGAATTTGAAATTGAAGGTGAAGGCGA
AGGTCGTCCGTATGAAGGCACCCAGACCGCAAAACTGAAAGTTACCAAAGGTGGTCCGCTGCCGTTTGCATGGGATA
TTCTGAGTCCGCAGTTTATGTATGGTAGCAAAGCCTATGTTAAACATCCGGCAGATATCCCGGATTATCTGAAACTG
AGCTTTCCGGAAGGTTTTAAATGGGAACGTGTGATGAATTTTGAAGATGGTGGTGTTGTTACCGTTACACAGGATAG
CAGCCTGCAGGATGGTGAATTTATCTATAAAGTTAAACTGCGTGGCACGAATTTTCCGAGTGATGGTCCGGTTATGC
AGAAAAAAACCATGGGTTGGGAAGCAAGCAGCGAACGTATGTATCCGGAAGATGGCGCACTGAAAGGTGAAATTAAA
CAGCGTCTGAAGCTGAAAGATGGCGGTCATTATGATGCAGAAGTTAAAACCACCTACAAAGCCAAAAAACCGGTTCA
GCTGCCTGGTGCATATAACGTTAACATTAAACTGGATATCACCAGCCACAACGAGGATTATACCATTGTTGAACAGT
ATGAACGTGCAGAAGGTCGCGCCATAGTACCGGTGGTATGGATGAACTGTATAAA
```

(Cas9-APAPAPA-mCherry chimera DNA sequence)

SEQ ID NO: 376

```
ATGGACAAAAAGTACTCTATTGGCCTGGATATCGGGACCAACAGCGTCGGGTGGCTGTTATCACCGACGAGTATAA
AGTACCTTCGAAAAAGTTCAAAGTGCTGGGCAACACCGATCGCCATTCAATCAAAAAGAACTTGATTGGTGCGCTGT
TGTTTGACTCCGGGGAAACCGCCGAGGCGACTCGCCTTAAACGTACAGCACGTCGCCGGTACACTCGGCGTAAGAAT
CGCATTTGCTATTTGCAGGAAATCTTTAGCAACGAGATGGCAAAAGTCGATGACTCGTTTTTCCACCGCCTCGAGGA
AAGCTTTCTGGTGGAGGAAGACAAAAAGCATGAGCGTCACCCGATCTTCGGCAACATTGTCGATGAAGTAGCGTATC
ATGAAAAATACCCAACCATTTACCACTTACGCAAAAAGCTGGTGGACAGCACTGACAAAGCTGATTTGCGCCTTATC
TATTTAGCCCTGGCACATATGATTAAGTTTCGTGGTCACTTCCTGATCGAAGGAGACTTAAATCCCGACAACAGTGA
```

-continued

```
TGTTGATAAATTGTTTATTCAGCTTGTCCAAACTTACAATCAACTGTTCGAGGAAAACCCGATCAATGCCTCCGGTG
TGGATGCAAAAGCCATTTTAAGTGCACGCCTTAGCAAGTCCCGTCGCTTAGAAAACCTTATCGCGCAGCTGCCCGGC
GAGAAAAAGAATGGTTTGTTTGGGAACCTTATTGCCTTGAGCTTAGGCCTCACCCCGAATTTCAAAAGTAATTTCGA
TCTTGCAGAAGACGCCAAATTACAACTGTCGAAGGATACTTATGATGACGATCTCGATAATCTGTTAGCGCAGATTG
GTGACCAATACGCCGATCTTTTCTGGCGGCTAAAAATCTGAGCGACGCCATCTTGCTTTCGGATATTCTCCGCGTT
AACACCGAAATCACGAAAGCGCCTCTTAGTGCCAGCATGATTAAACGTTATGATGAACACCACCAGGACCTGACCTT
ACTCAAAGCGTTGGTTCGCCAGCAACTGCCAGAGAAGTACAAAGAAATCTTCTTTGATCAGTCAAAGAATGGTTATG
CCGGCTATATTGACGGGGGTGCAAGCCAAGAGGAATTCTACAAATTTATCAAGCCTATTCTGGAGAAAATGGATGGC
ACCGAAGAGTTATTGGTGAAGCTTAACCGTGAAGACCTCCTGCGGAAACAGCGCACATTCGATAATGGTTCGATCCC
ACACCAAATCCATTTGGGGGAGTTACACGCTATTTTGCGTCGCCAGGAAGACTTTTACCCTTTCCTGAAGGATAACC
GGGAGAAAATTGAGAAGATCCTTACCTTTCGTATTCCGTATTACGTAGGCCCCTTAGCACGGGGTAATAGCCGTTTC
GCGTGGATGACACGGAAGTCGGAAGAGACGATCACCCCGTGGAACTTCGAAGAGGTAGTCGACAAGGGCGCATCAGC
GCAGTCTTTTATTGAACGTATGACGAATTTCGATAAAAACTTGCCCAATGAGAAGGTGCTTCCGAAACATTCCTTGT
TATATGAATATTTTACAGTTTACAACGAGCTGACCAAGGTTAAATACGTGACGGAAGGAATGCGCAAGCCCGCTTTT
CTTAGCGGTGAGCAAAAAAAGGCGATCGTCGACCTGTTATTCAAAACGAATCGTAAGGTGACTGTAAAGCAACTCAA
AGAAGATTACTTCAAAAAGATTGAGTGCTTCGACAGCGTCGAAATCTCTGGGGTAGAGGATCGGTTTAACGCAAGTT
TAGGTACCTACCATGACCTGCTTAAAATCATTAAGGATAAAGACTTCTTAGATAATGAAGAGAACGAAGATATTCTC
GAGGACATCGTCTTGACGTTAACCTTATTTGAGGATCGTGAAATGATTGAGGAACGCCTCAAAACTTATGCCCACCT
GTTCGACGATAAGGTGATGAAGCAGCTGAAACGTCGGCGCTACACAGGATGGGGCCGCTTGAGTCGCAAACTTATTA
ACGGAATCCGTGACAAGCAATCCGGCAAAACGATTCTGGATTTCTTGAAGTCGGACGGATTTGCTAATCGCAACTTC
ATGCAGTTGATCCATGATGACTCCCTGACTTTTAAAGAGGATATTCAAAAGGCGCAGGTTAGTGGTCAAGGCGACAG
CTTACACGAACACATCGCAAATTTGGCTGGTTCGCCGGCCATTAAAAAGGGGATCCTCCAGACCGTGAAAGTTGTAG
ATGAGCTTGTTAAGGTCATGGGTCGTCATAAGCCCGAAAACATCGTGATTGAAATGGCGCGGGAGAATCAAACGACC
CAGAAAGGACAAAAGAATAGCCGTGAACGGATGAAGCGGATCGAGGAAGGCATTAAAGAGCTGGGGTCTCAAATCTT
GAAGGAACACCCTGTGGAGAACACTCAGCTCCAAAATGAAAAACTTTACCTGTACTATTTGCAGAACGGACGCGATA
TGTACGTGGACCAAGAGTTGGATATTAATCGGCTGAGTGACTACGACGTTGATCATATCGTCCCGCAGAGCTTCCTC
AAAGACGATTCTATTGACAATAAGGTACTGACGCGCTCTGATAAAAACCGTGGTAAGTCGGACAACGTGCCCTCCGA
AGAGGTTGTGAAAAAGATGAAAAATTATTGGCGCCAGCTTTTAAACGCGAAGCTGATCACACAACGTAAATTCGATA
ATTTGACCAAGGCTGAACGGGGTGGCCTGAGCGAGTTAGATAAGGCAGGATTTATTAAACGCCAGTTAGTGGAGACT
CGTCAAATCACCAAACATGTCGCGCAGATTTTGGACAGCCGGATGAACACCAAGTACGATGAAAATGACAAACTGAT
CCGTGAGGTGAAAGTCATTACTCTGAAGTCCAAATTAGTTAGTGATTTCCGGAAGGACTTTCAATTCTACAAAGTCC
GTGAAATTAATAACTATCATCACGCACATGACGCGTACCTGAATGCAGTGGTTGGGACCGCCCTTATCAAGAAATAT
CCTAAGCTGGAGTCGGAGTTTGTCTATGGCGACTATAAGGTATACGATGTTCGCAAAATGATTGCGAAATCTGAGCA
GGAGATCGGTAAGGCAACCGCAAAATATTTCTTTTACTCAAACATTATGAATTTCTTTAAGACAGAAATCACTCTGG
CCAACGGGAGATTCGCAAACGTCCGTTGATCGAAACAAACGGCGAGACTGGCGAAATTGTTTGGGACAAAGGGCGT
GATTTCGCGACGGTGCGCAAGGTACTGAGCATGCCTCAAGTCAATATTGTTAAGAAAACCGAAGTGCAGACGGGCGG
GTTTTCCAAGGAAAGCATCTTACCCAAACGTAATTCAGATAAACTTATTGCACGCAAAAAGGACTGGGATCCGAAAA
AGTATGGAGGCTTCGACAGTCCAACCGTAGCCTACTCTGTTCTCGTTGTAGCGAAAGTAGAAAAGGGTAAATCCAAG
AAACTGAAATCTGTCAAGGAGTTGCTTGGAATCACCATTATGGAGCGTAGCTCCTTCGAGAAGAACCCGATTGACTT
TCTGGAAGCCAAAGGATATAAAGAGGTCAAGAAAGATCTTATCATTAAGCTGCCTAAGTATTCACTCTTCGAGCTGG
AAAATGGTCGTAAACGCATGCTCGCTTCTGCCGGCGAGTTGCAGAAGGGCAATGAATTAGCACTTCCATCAAAGTAC
```

-continued

```
GTTAACTTCCTGTATTTGGCCAGCCATTACGAGAAACTGAAGGGGTCTCCAGAGGACAACGAACAGAAACAATTATT

TGTAGAGCAGCACAAGCATTATCTTGATGAAATCATTGAGCAAATTTCCGAATTCAGTAAACGCGTAATCCTGGCCG

ATGCAAACCTCGACAAGGTGCTGAGCGCTTACAATAAGCATCGCGACAAACCTATCCGTGAGCAGGCTGAAAATATC

ATTCACCTGTTCACATTAACGAACCTGGGCGCTCCGGCCGCTTTTAAATATTTCGACACGACAATCGACCGTAAGCG

CTATACCAGTACGAAAGAAGTGTTGGATGCGACCCTTATTCACCAGTCAATTACAGGATTATATGAGACCCGTATCG

ACCTTAGCCAATTAGGTGGGGATGCGCCAGCTCCTGCACCTGCGATGGTGAGCAAAGGTGAAGAGGATAATATGGCC

ATCATCAAAGAATTCATGCGCTTCAAAGTTCATATGGAAGGTAGCGTTAATGGCCACGAATTTGAAATTGAAGGTGA

AGGCGAAGGTCGTCCGTATGAAGGCACCCAGACCGCAAAACTGAAAGTTACCAAAGGTGGTCCGCTGCCGTTTGCAT

GGGATATTCTGAGTCCGCAGTTTATGTATGGTAGCAAAGCCTATGTTAAACATCCGGCAGATATCCCGGATTATCTG

AAACTGAGCTTTCCGGAAGGTTTTAAATGGGAACGTGTGATGAATTTTGAAGATGGTGGTGTTGTTACCGTTACACA

GGATAGCAGCCTGCAGGATGGTGAATTTATCTATAAAGTTAAACTGCGTGGCACGAATTTTCCGAGTGATGGTCCGG

TTATGCAGAAAAAAACCATGGGTTGGGAAGCAAGCAGCGAACGTATGTATCCGGAAGATGGCGCACTGAAAGGTGAA

ATTAAACAGCGTCTGAAGCTGAAAGATGGCGGTCATTATGATGCAGAAGTTAAAACCACCTACAAAGCCAAAAAACC

GGTTCAGCTGCCTGGTGCATATAACGTTAACATTAAACTGGATATCACCAGCCACAACGAGGATTATACCATTGTTG

AACAGTATGAACGTGCAGAAGGTCGCCATAGTACCGGTGGTATGGATGAACTGTATAAA
```

(Cas9-APAPAPAPA-mCherry chimera DNA sequence)

SEQ ID NO: 377

```
ATGGACAAAAAGTACTCTATTGGCCTGGATATCGGGACCAACAGCGTCGGGTGGCTGTTATCACCGACGAGTATAA

AGTACCTTCGAAAAAGTTCAAAGTGCTGGGCAACACCGATCGCCATTCAATCAAAAAGAACTTGATTGGTGCGCTGT

TGTTTGACTCCGGGGAAACCGCCGAGGCGACTCGCCTTAAACGTACAGCACGTCGCCGGTACACTCGGCGTAAGAAT

CGCATTTGCTATTTGCAGGAAATCTTTAGCAACGAGATGGCAAAAGTCGATGACTCGTTTTTCCACCGCCTCGAGGA

AAGCTTTCTGGTGGAGGAAGACAAAAAGCATGAGCGTCACCCGATCTTCGGCAACATTGTCGATGAAGTAGCGTATC

ATGAAAAATACCCAACCATTTACCACTTACGCAAAAAGCTGGTGGACAGCACTGACAAAGCTGATTTGCGCCTTATC

TATTTAGCCCTGGCACATATGATTAAGTTTCGTGGTCACTTCCTGATCGAAGGAGACTTAAATCCCGACAACAGTGA

TGTTGATAAATTGTTTATTCAGCTTGTCCAAACTTACAATCAACTGTTCGAGGAAAACCCGATCAATGCCTCCGGTG

TGGATGCAAAAGCCATTTTAAGTGCACGCCTTAGCAAGTCCCGTCGCTTAGAAAACCTTATCGCGCAGCTGCCCGGC

GAGAAAAAGAATGGTTTGTTTGGGAACCTTATTGCCTTGAGCTTAGGCCTCACCCCGAATTTCAAAAGTAATTTCGA

TCTTGCAGAAGACGCCAAATTACAACTGTCGAAGGATACTTATGATGACGATCTCGATAATCTGTTAGCGCAGATTG

GTGACCAATACGCCGATCTTTTTCTGGCGGCTAAAAATCTGAGCGACGCCATCTTGCTTTCGGATATTCTCCGCGTT

AACACCGAAATCACGAAAGCGCCTCTTAGTGCCAGCATGATTAAACGTTATGATGAACACCACCAGGACCTGACCTT

ACTCAAAGCGTTGGTTCGCCAGCAACTGCCAGAGAAGTACAAAGAAATCTTCTTTGATCAGTCAAAGAATGGTTATG

CCGGCTATATTGACGGGGGTGCAAGCCAAGAGGAATTCTACAAATTTATCAAGCCTATTCTGGAGAAAATGGATGGC

ACCGAAGAGTTATTGGTGAAGCTTAACCGTGAAGACCTCCTGCGGAAACAGCGCACATTCGATAATGGTTCGATCCC

ACACCAAATCCATTTGGGGGAGTTACACGCTATTTTGCGTCGCCAGGAAGACTTTTACCCTTTCCTGAAGGATAACC

GGGAGAAAATTGAGAAGATCCTTACCTTTCGTATTCCGTATTACGTAGGCCCCTTAGCACGGGGTAATAGCCGTTTC

GCGTGGATGACACGGAAGTCGGAAGAGACGATCACCCCGTGGAACTTCGAAGAGGTAGTCGACAAGGGCGCATCAGC

GCAGTCTTTTATTGAACGTATGACGAATTTCGATAAAAACTTGCCCAATGAGAAGGTGCTTCCGAAACATTCCTTGT

TATATGAATATTTTACAGTTTACAACGAGCTGACCAAGGTTAAATACGTGACGGAAGGAATGCGCAAGCCCGCTTTT

CTTAGCGGTGAGCAAAAAAAGGCGATCGTCGACCTGTTATTCAAAACGAATCGTAAGGTGACTGTAAAGCAACTCAA

AGAAGATTACTTCAAAAAGATTGAGTGCTTCGACAGCGTCGAAATCTCTGGGGTAGAGGATCGGTTTAACGCAAGTT

TAGGTACCTACCATGACCTGCTTAAAATCATTAAGGATAAAGACTTCTTAGATAATGAAGAGAACGAAGATATTCTC
```

-continued

```
GAGGACATCGTCTTGACGTTAACCTTATTTGAGGATCGTGAAATGATTGAGGAACGCCTCAAAACTTATGCCCACCT
GTTCGACGATAAGGTGATGAAGCAGCTGAAACGTCGGCGCTACACAGGATGGGGCCGCTTGAGTCGCAAACTTATTA
ACGGAATCCGTGACAAGCAATCCGGCAAAACGATTCTGGATTTCTTGAAGTCGGACGGATTTGCTAATCGCAACTTC
ATGCAGTTGATCCATGATGACTCCCTGACTTTTAAAGAGGATATTCAAAAGGCGCAGGTTAGTGGTCAAGGCGACAG
CTTACACGAACACATCGCAAATTTGGCTGGTTCGCCGGCCATTAAAAAGGGGATCCTCCAGACCGTGAAAGTTGTAG
ATGAGCTTGTTAAGGTCATGGGTCGTCATAAGCCCGAAAACATCGTGATTGAAATGGCGCGGGAGAATCAAACGACC
CAGAAAGGACAAAAGAATAGCCGTGAACGGATGAAGCGGATCGAGGAAGGCATTAAAGAGCTGGGGTCTCAAATCTT
GAAGGAACACCCTGTGGAGAACACTCAGCTCCAAAATGAAAAACTTTACCTGTACTATTTGCAGAACGGACGCGATA
TGTACGTGGACCAAGAGTTGGATATTAATCGGCTGAGTGACTACGACGTTGATCATATCGTCCCGCAGAGCTTCCTC
AAAGACGATTCTATTGACAATAAGGTACTGACGCGCTCTGATAAAAACCGTGGTAAGTCGGACAACGTGCCCTCCGA
AGAGGTTGTGAAAAAGATGAAAAATTATTGGCGCCAGCTTTTAAACGCGAAGCTGATCACACAACGTAAATTCGATA
ATTTGACCAAGGCTGAACGGGGTGGCCTGAGCGAGTTAGATAAGGCAGGATTTATTAAACGCCAGTTAGTGGAGACT
CGTCAAATCACCAAACATGTCGCGCAGATTTTGGACAGCCGGATGAACACCAAGTACGATGAAAATGACAAACTGAT
CCGTGAGGTGAAAGTCATTACTCTGAAGTCCAAATTAGTTAGTGATTTCCGGAAGGACTTTCAATTCTACAAAGTCC
GTGAAATTAATAACTATCATCACGCACATGACGCGTACCTGAATGCAGTGGTTGGGACCGCCCTTATCAAGAAATAT
CCTAAGCTGGAGTCGGAGTTTGTCTATGGCGACTATAAGGTATACGATGTTCGCAAAATGATTGCGAAATCTGAGCA
GGAGATCGGTAAGGCAACCGCAAAATATTTCTTTTACTCAAACATTATGAATTTCTTTAAGACAGAAATCACTCTGG
CCAACGGGGAGATTCGCAAACGTCCGTTGATCGAAACAAACGGCGAGACTGGCGAAATTGTTTGGGACAAAGGGCGT
GATTTCGCGACGGTGCGCAAGGTACTGAGCATGCCTCAAGTCAATATTGTTAAGAAAACCGAAGTGCAGACGGGCGG
GTTTTCCAAGGAAAGCATCTTACCCAAACGTAATTCAGATAAACTTATTGCACGCAAAAAGGACTGGGATCCGAAAA
AGTATGGAGGCTTCGACAGTCCAACCGTAGCCTACTCTGTTCTCGTTGTAGCGAAAGTAGAAAAGGGTAAATCCAAG
AAACTGAAATCTGTCAAGGAGTTGCTTGGAATCACCATTATGGAGCGTAGCTCCTTCGAGAAGAACCCGATTGACTT
TCTGGAAGCCAAAGGATATAAAGAGGTCAAGAAAGATCTTATCATTAAGCTGCCTAAGTATTCACTCTTCGAGCTGG
AAAATGGTCGTAAACGCATGCTCGCTTCTGCCGGCGAGTTGCAGAAGGGCAATGAATTAGCACTTCCATCAAAGTAC
GTTAACTTCCTGTATTTGGCCAGCCATTACGAGAAACTGAAGGGGTCTCCAGAGGACAACGAACAGAAACAATTATT
TGTAGAGCAGCACAAGCATTATCTTGATGAAATCATTGAGCAAATTTCCGAATTCAGTAAACGCGTAATCCTGGCCG
ATGCAAACCTCGACAAGGTGCTGAGCGCTTACAATAAGCATCGCGACAAACCTATCCGTGAGCAGGCTGAAAATATC
ATTCACCTGTTCACATTAACGAACCTGGGCGCTCCGGCCGCTTTTAAATATTTCGACACGACAATCGACCGTAAGCG
CTATACCAGTACGAAAGAAGTGTTGGATGCGACCCTTATTCACCAGTCAATTACAGGATTATATGAGACCCGTATCG
ACCTTAGCCAATTAGGTGGGGATGCTCCTGCGCCAGCTCCTGCACCTGCGATGGTGAGCAAAGGTGAAGAGGATAAT
ATGGCCATCATCAAAGAATTCATGCGCTTCAAAGTTCATATGGAAGGTAGCGTTAATGGCCACGAATTTGAAATTGA
AGGTGAAGGCGAAGGTCGTCCGTATGAAGGCACCCAGACCGCAAAACTGAAAGTTACCAAAGGTGGTCCGCTGCCGT
TTGCATGGGATATTCTGAGTCCGCAGTTTATGTATGGTAGCAAAGCCTATGTTAAACATCCGGCAGATATCCCGGAT
TATCTGAAACTGAGCTTTCCGGAAGGTTTTAAATGGGAACGTGTGATGAATTTTGAAGATGGTGGTGTTGTTACCGT
TACACAGGATAGCAGCCTGCAGGATGGTGAATTTATCTATAAAGTTAAACTGCGTGGCACGAATTTTCCGAGTGATG
GTCCGGTTATGCAGAAAAAAACCATGGGTTGGGAAGCAAGCAGCGAACGTATGTATCCGGAAGATGGCGCACTGAAA
GGTGAAATTAAACAGCGTCTGAAGCTGAAAGATGGCGGTCATTATGATGCAGAAGTTAAAACCACCTACAAAGCCAA
AAAACCGGTTCAGCTGCCTGGTGCATATAACGTTAACATTAAACTGGATATCACCAGCCACAACGAGGATTATACCA
TTGTTGAACAGTATGAACGTGCAGAAGGTCGCCATAGTACCGGTGGTATGGATGAACTGTATAAA
```

(Cas9-APAPAPAPAPA-mCherry chimera DNA sequence)

SEQ ID NO: 378

ATGGACAAAAAGTACTCTATTGGCCTGGATATCGGGACCAACAGCGTCGGGTGGGCTGTTATCACCGACGAGTATAA
AGTACCTTCGAAAAAGTTCAAAGTGCTGGGCAACACCGATCGCCATTCAATCAAAAAGAACTTGATTGGTGCGCTGT
TGTTTGACTCCGGGGAAACCGCCGAGGCGACTCGCCTTAAACGTACAGCACGTCGCCGGTACACTCGGCGTAAGAAT
CGCATTTGCTATTTGCAGGAAATCTTTAGCAACGAGATGGCAAAAGTCGATGACTCGTTTTTCCACCGCCTCGAGGA
AAGCTTTCTGGTGGAGGAAGACAAAAAGCATGAGCGTCACCCGATCTTCGGCAACATTGTCGATGAAGTAGCGTATC
ATGAAAAATACCCAACCATTTACCACTTACGCAAAAAGCTGGTGGACAGCACTGACAAAGCTGATTTGCGCCTTATC
TATTTAGCCCTGGCACATATGATTAAGTTTCGTGGTCACTTCCTGATCGAAGGAGACTTAAATCCCGACAACAGTGA
TGTTGATAAATTGTTTATTCAGCTTGTCCAAACTTACAATCAACTGTTCGAGGAAAACCCGATCAATGCCTCCGGTG
TGGATGCAAAAGCCATTTTAAGTGCACGCCTTAGCAAGTCCCGTCGCTTAGAAAACCTTATCGCGCAGCTGCCCGGC
GAGAAAAAGAATGGTTTGTTTGGGAACCTTATTGCCTTGAGCTTAGGCCTCACCCCGAATTTCAAAAGTAATTTCGA
TCTTGCAGAAGACGCCAAATTACAACTGTCGAAGGATACTTATGATGACGATCTCGATAATCTGTTAGCGCAGATTG
GTGACCAATACGCCGATCTTTTTCTGGCGGCTAAAAATCTGAGCGACGCCATCTTGCTTTCGGATATTCTCCGCGTT
AACACCGAAATCACGAAAGCGCCTCTTAGTGCCAGCATGATTAAACGTTATGATGAACACCACCAGGACCTGACCTT
ACTCAAAGCGTTGGTTCGCCAGCAACTGCCAGAGAAGTACAAAGAAATCTTCTTTGATCAGTCAAAGAATGGTTATG
CCGGCTATATTGACGGGGGTGCAAGCCAAGAGGAATTCTACAAATTTATCAAGCCTATTCTGGAGAAAATGGATGGC
ACCGAAGAGTTATTGGTGAAGCTTAACCGTGAAGACCTCCTGCGGAAACAGCGCACATTCGATAATGGTTCGATCCC
ACACCAAATCCATTTGGGGGAGTTACACGCTATTTTGCGTCGCCAGGAAGACTTTTACCCTTTCCTGAAGGATAACC
GGGAGAAAATTGAGAAGATCCTTACCTTTCGTATTCCGTATTACGTAGGCCCCTTAGCACGGGGTAATAGCCGTTTC
GCGTGGATGACACGGAAGTCGGAAGAGACGATCACCCCGTGGAACTTCGAAGAGGTAGTCGACAAGGGCGCATCAGC
GCAGTCTTTTATTGAACGTATGACGAATTTCGATAAAAACTTGCCCAATGAGAAGGTGCTTCCGAAACATTCCTTGT
TATATGAATATTTTACAGTTTACAACGAGCTGACCAAGGTTAAATACGTGACGGAAGGAATGCGCAAGCCCGCTTTT
CTTAGCGGTGAGCAAAAAAGGCGATCGTCGACCTGTTATTCAAAACGAATCGTAAGGTGACTGTAAAGCAACTCAA
AGAAGATTACTTCAAAAAGATTGAGTGCTTCGACAGCGTCGAAATCTCTGGGGTAGAGGATCGGTTTAACGCAAGTT
TAGGTACCTACCATGACCTGCTTAAAATCATTAAGGATAAAGACTTCTTAGATAATGAAGAGAACGAAGATATTCTC
GAGGACATCGTCTTGACGTTAACCTTATTTGAGGATCGTGAAATGATTGAGGAACGCCTCAAAACTTATGCCCACCT
GTTCGACGATAAGGTGATGAAGCAGCTGAAACGTCGGCGCTACACAGGATGGGGCCGCTTGAGTCGCAAACTTATTA
ACGGAATCCGTGACAAGCAATCCGGCAAAACGATTCTGGATTTCTTGAAGTCGGACGGATTTGCTAATCGCAACTTC
ATGCAGTTGATCCATGATGACTCCCTGACTTTTAAAGAGGATATTCAAAAGGCGCAGGTTAGTGGTCAAGGCGACAG
CTTACACGAACACATCGCAAATTTGGCTGGTTCGCCGGCCATTAAAAAGGGGATCCTCCAGACCGTGAAAGTTGTAG
ATGAGCTTGTTAAGGTCATGGGTCGTCATAAGCCCGAAAACATCGTGATTGAAATGGCGCGGGAGAATCAAACGACC
CAGAAAGGACAAAAGAATAGCCGTGAACGGATGAAGCGGATCGAGGAAGGCATTAAAGAGCTGGGGTCTCAAATCTT
GAAGGAACACCCTGTGGAGAACACTCAGCTCCAAAATGAAAAACTTTACCTGTACTATTTGCAGAACGGACGCGATA
TGTACGTGGACCAAGAGTTGGATATTAATCGGCTGAGTGACTACGACGTTGATCATATCGTCCCGCAGAGCTTCCTC
AAAGACGATTCTATTGACAATAAGGTACTGACGCGCTCTGATAAAAACCGTGGTAAGTCGGACAACGTGCCCTCCGA
AGAGGTTGTGAAAAAGATGAAAAATTATTGGCGCCAGCTTTTAAACGCGAAGCTGATCACACAACGTAAATTCGATA
ATTTGACCAAGGCTGAACGGGGTGGCCTGAGCGAGTTAGATAAGGCAGGATTTATTAAACGCAGTTAGTGGAGACT
CGTCAAATCACCAAACATGTCGCGCAGATTTTGGACAGCCGGATGAACACCAAGTACGATGAAAATGACAAACTGAT
CCGTGAGGTGAAAGTCATTACTCTGAAGTCCAAATTAGTTAGTGATTTCCGAAGGACTTTCAATTCTACAAAGTCC
GTGAAATTAATAACTATCATCACGCACATGACGCGTACCTGAATGCAGTGGTTGGGACCGCCCTTATCAAGAAATAT

-continued

CCTAAGCTGGAGTCGGAGTTTGTCTATGGCGACTATAAGGTATACGATGTTCGCAAAATGATTGCGAAATCTGAGCA

GGAGATCGGTAAGGCAACCGCAAAATATTTCTTTTACTCAAACATTATGAATTTCTTTAAGACAGAAATCACTCTGG

CCAACGGGGAGATTCGCAAACGTCCGTTGATCGAAACAAACGGCGAGACTGGCGAAATTGTTTGGGACAAAGGGCGT

GATTTCGCGACGGTGCGCAAGGTACTGAGCATGCCTCAAGTCAATATTGTTAAGAAAACCGAAGTGCAGACGGGCGG

GTTTTCCAAGGAAAGCATCTTACCCAAACGTAATTCAGATAAACTTATTGCACGCAAAAAGGACTGGGATCCGAAAA

AGTATGGAGGCTTCGACAGTCCAACCGTAGCCTACTCTGTTCTCGTTGTAGCGAAAGTAGAAAAGGGTAAATCCAAG

AAACTGAAATCTGTCAAGGAGTTGCTTGGAATCACCATTATGGAGCGTAGCTCCTTCGAGAAGAACCCGATTGACTT

TCTGGAAGCCAAAGGATATAAAGAGGTCAAGAAAGATCTTATCATTAAGCTGCCTAAGTATTCACTCTTCGAGCTGG

AAAATGGTCGTAAACGCATGCTCGCTTCTGCCGGCGAGTTGCAGAAGGGCAATGAATTAGCACTTCCATCAAAGTAC

GTTAACTTCCTGTATTTGGCCAGCCATTACGAGAAACTGAAGGGGTCTCCAGAGGACAACGAACAGAAACAATTATT

TGTAGAGCAGCACAAGCATTATCTTGATGAAATCATTGAGCAAATTTCCGAATTCAGTAAACGCGTAATCCTGGCCG

ATGCAAACCTCGACAAGGTGCTGAGCGCTTACAATAAGCATCGCGACAAACCTATCCGTGAGCAGGCTGAAAATATC

ATTCACCTGTTCACATTAACGAACCTGGGCGCTCCGGCCGCTTTTAAATATTTCGACACGACAATCGACCGTAAGCG

CTATACCAGTACGAAAGAAGTGTTGGATGCGACCCTTATTCACCAGTCAATTACAGGATTATATGAGACCCGTATCG

ACCTTAGCCAATTAGGTGGGGATGCGCCCGCTCCTGCGCCAGCTCCTGCACCTGCGATGGTGAGCAAAGGTGAAGAG

GATAATATGGCCATCATCAAAGAATTCATGCGCTTCAAAGTTCATATGGAAGGTAGCGTTAATGGCCACGAATTTGA

AATTGAAGGTGAAGGCGAAGGTCGTCCGTATGAAGGCACCCAGACCGCAAAACTGAAAGTTACCAAAGGTGGTCCGC

TGCCGTTTGCATGGGATATTCTGAGTCCGCAGTTTATGTATGGTAGCAAAGCCTATGTTAAACATCCGGCAGATATC

CCGGATTATCTGAAACTGAGCTTTCCGGAAGGTTTTAAATGGGAACGTGTGATGAATTTTGAAGATGGTGGTGTTGT

TACCGTTACACAGGATAGCAGCCTGCAGGATGGTGAATTTATCTATAAAGTTAAACTGCGTGGCACGAATTTTCCGA

GTGATGGTCCGGTTATGCAGAAAAAAACCATGGGTTGGGAAGCAAGCAGCGAACGTATGTATCCGGAAGATGGCGCA

CTGAAAGGTGAAATTAAACAGCGTCTGAAGCTGAAAGATGGCGGTCATTATGATGCAGAAGTTAAAACCACCTACAA

AGCCAAAAAACCGGTTCAGCTGCCTGGTGCATATAACGTTAACATTAAACTGGATATCACCAGCCACAACGAGGATT

ATACCATTGTTGAACAGTATGAACGTGCAGAAGGTCGCCATAGTACCGGTGGTATGGATGAACTGTATAAA (Cas9-APAPAPAPAPAPA-mCherry chimera DNA sequence)

SEQ ID NO: 379

ATGGACAAAAAGTACTCTATTGGCCTGGATATCGGGACCAACAGCGTCGGGTGGGCTGTTATCACCGACGAGTATAA

AGTACCTTCGAAAAAGTTCAAAGTGCTGGGCAACACCGATCGCCATTCAATCAAAAAGAACTTGATTGGTGCGCTGT

TGTTTGACTCCGGGGAAACCGCCGAGGCGACTCGCCTTAAACGTACAGCACGTCGCCGGTACACTCGGCGTAAGAAT

CGCATTTGCTATTTGCAGGAAATCTTTAGCAACGAGATGGCAAAAGTCGATGACTCGTTTTTCCACCGCCTCGAGGA

AAGCTTTCTGGTGGAGGAAGACAAAAAGCATGAGCGTCACCCGATCTTCGGCAACATTGTCGATGAAGTAGCGTATC

ATGAAAAATACCCAACCATTTACCACTTACGCAAAAAGCTGGTGGACAGCACTGACAAAGCTGATTTGCGCCTTATC

TATTTAGCCCTGGCACATATGATTAAGTTTCGTGGTCACTTCCTGATCGAAGGAGACTTAAATCCCGACAACAGTGA

TGTTGATAAATTGTTTATTCAGCTTGTCCAAACTTACAATCAACTGTTCGAGGAAAACCCGATCAATGCCTCCGGTG

TGGATGCAAAAGCCATTTTAAGTGCACGCCTTAGCAAGTCCCGTCGCTTAGAAAACCTTATCGCGCAGCTGCCCGGC

GAGAAAAAGAATGGTTTGTTTGGGAACCTTATTGCCTTGAGCTTAGGCCTCACCCCGAATTTCAAAAGTAATTTCGA

TCTTGCAGAAGACGCCAAATTACAACTGTCGAAGGATACTTATGATGACGATCTCGATAATCTGTTAGCGCAGATTG

GTGACCAATACGCCGATCTTTTTCTGGCGGCTAAAAATCTGAGCGACGCCATCTTGCTTTCGGATATTCTCCGCGTT

AACACCGAAATCACGAAAGCGCCTCTTAGTGCCAGCATGATTAAACGTTATGATGAACACCACCAGGACCTGACCTT

ACTCAAAGCGTTGGTTCGCCAGCAACTGCCAGAGAAGTACAAAGAAATCTTCTTTGATCAGTCAAAGAATGGTTATG

CCGGCTATATTGACGGGGGTGCAAGCCAAGAGGAATTCTACAAATTTATCAAGCCTATTCTGGAGAAAATGGATGGC

ACCGAAGAGTTATTGGTGAAGCTTAACCGTGAAGACCTCCTGCGGAAACAGCGCACATTCGATAATGGTTCGATCCC

-continued

```
ACACCAAATCCATTTGGGGGAGTTACACGCTATTTTGCGTCGCCAGGAAGACTTTTACCCTTTCCTGAAGGATAACC
GGGAGAAAATTGAGAAGATCCTTACCTTTCGTATTCCGTATTACGTAGGCCCCTTAGCACGGGGTAATAGCCGTTTC
GCGTGGATGACACGGAAGTCGGAAGAGACGATCACCCCGTGGAACTTCGAAGAGGTAGTCGACAAGGGCGCATCAGC
GCAGTCTTTTATTGAACGTATGACGAATTTCGATAAAAACTTGCCCAATGAGAAGGTGCTTCCGAAACATTCCTTGT
TATATGAATATTTTACAGTTTACAACGAGCTGACCAAGGTTAAATACGTGACGGAAGGAATGCGCAAGCCCGCTTTT
CTTAGCGGTGAGCAAAAAAGGCGATCGTCGACCTGTTATTCAAAACGAATCGTAAGGTGACTGTAAAGCAACTCAA
AGAAGATTACTTCAAAAAGATTGAGTGCTTCGACAGCGTCGAAATCTCTGGGGTAGAGGATCGGTTTAACGCAAGTT
TAGGTACCTACCATGACCTGCTTAAAATCATTAAGGATAAAGACTTCTTAGATAATGAAGAGAACGAAGATATTCTC
GAGGACATCGTCTTGACGTTAACCTTATTTGAGGATCGTGAAATGATTGAGGAACGCCTCAAAACTTATGCCCACCT
GTTCGACGATAAGGTGATGAAGCAGCTGAAACGTCGGCGCTACACAGGATGGGGCCGCTTGAGTCGCAAACTTATTA
ACGGAATCCGTGACAAGCAATCCGGCAAAACGATTCTGGATTTCTTGAAGTCGGACGGATTTGCTAATCGCAACTTC
ATGCAGTTGATCCATGATGACTCCCTGACTTTTAAAGAGGATATTCAAAAGGCGCAGGTTAGTGGTCAAGGCGACAG
CTTACACGAACACATCGCAAATTTGGCTGGTTCGCCGGCCATTAAAAAGGGGATCCTCCAGACCGTGAAAGTTGTAG
ATGAGCTTGTTAAGGTCATGGGTCGTCATAAGCCCGAAAACATCGTGATTGAAATGGCGCGGGAGAATCAAACGACC
CAGAAAGGACAAAAGAATAGCCGTGAACGGATGAAGCGGATCGAGGAAGGCATTAAAGAGCTGGGGTCTCAAATCTT
GAAGGAACACCCTGTGGAGAACACTCAGCTCCAAAATGAAAAACTTTACCTGTACTATTTGCAGAACGGACGCGATA
TGTACGTGGACCAAGAGTTGGATATTAATCGGCTGAGTGACTACGACGTTGATCATATCGTCCCGCAGAGCTTCCTC
AAAGACGATTCTATTGACAATAAGGTACTGACGCGCTCTGATAAAAACCGTGGTAAGTCGGACAACGTGCCCTCCGA
AGAGGTTGTGAAAAAGATGAAAAATTATTGGCGCCAGCTTTTAAACGCGAAGCTGATCACACAACGTAAATTCGATA
ATTTGACCAAGGCTGAACGGGGTGGCCTGAGCGAGTTAGATAAGGCAGGATTTATTAAACGCCAGTTAGTGGAGACT
CGTCAAATCACCAAACATGTCGCGCAGATTTTGGACAGCCGGATGAACACCAAGTACGATGAAAATGACAAACTGAT
CCGTGAGGTGAAAGTCATTACTCTGAAGTCCAAATTAGTTAGTGATTTCCGGAAGGACTTTCAATTCTACAAAGTCC
GTGAAATTAATAACTATCATCACGCACATGACGCGTACCTGAATGCAGTGGTTGGGACCGCCCTTATCAAGAAATAT
CCTAAGCTGGAGTCGGAGTTTGTCTATGGCGACTATAAGGTATACGATGTTCGCAAAATGATTGCGAAATCTGAGCA
GGAGATCGGTAAGGCAACCGCAAAATATTTCTTTTACTCAAACATTATGAATTTCTTTAAGACAGAAATCACTCTGG
CCAACGGGGAGATTCGCAAACGTCCGTTGATCGAAACAAACGGCGAGACTGGCGAAATTGTTTGGGACAAAGGGCGT
GATTTCGCGACGGTGCGCAAGGTACTGAGCATGCCTCAAGTCAATATTGTTAAGAAAACCGAAGTGCAGACGGGCGG
GTTTTCCAAGGAAAGCATCTTACCCAAACGTAATTCAGATAAACTTATTGCACGCAAAAAGGACTGGGATCCGAAAA
AGTATGGAGGCTTCGACAGTCCAACCGTAGCCTACTCTGTTCTCGTTGTAGCGAAAGTAGAAAAGGGTAAATCCAAG
AAACTGAAATCTGTCAAGGAGTTGCTTGGAATCACCATTATGGAGCGTAGCTCCTTCGAGAAGAACCCGATTGACTT
TCTGGAAGCCAAAGGATATAAAGAGGTCAAGAAAGATCTTATCATTAAGCTGCCTAAGTATTCACTCTTCGAGCTGG
AAAATGGTCGTAAACGCATGCTCGCTTCTGCCGGCGAGTTGCAGAAGGGCAATGAATTAGCACTTCCATCAAAGTAC
GTTAACTTCCTGTATTTGGCCAGCCATTACGAGAAACTGAAGGGGTCTCCAGAGGACAACGAACAGAAACAATTATT
TGTAGAGCAGCACAAGCATTATCTTGATGAAATCATTGAGCAAATTTCCGAATTCAGTAAACGCGTAATCCTGGCCG
ATGCAAACCTCGACAAGGTGCTGAGCGCTTACAATAAGCATCGCGACAAACCTATCCGTGAGCAGGCTGAAAATATC
ATTCACCTGTTCACATTAACGAACCTGGGCGCTCCGGCCGCTTTTAAATATTTCGACACGACAATCGACCGTAAGCG
CTATACCAGTACGAAAGAAGTGTTGGATGCGACCCTTATTCACCAGTCAATTACAGGATTATATGAGACCCGTATCG
ACCTTAGCCAATTAGGTGGGGATGCGCCAGCGCCTGCTCCTGCACCCGCTCCAGCACCTGCGATGGTGAGCAAAGGT
GAAGAGGATAATATGGCCATCATCAAAGAATTCATGCGCTTCAAAGTTCATATGGAAGGTAGCGTTAATGGCCACGA
ATTTGAAATTGAAGGTGAAGGCGAAGGTCGTCCGTATGAAGGCACCCAGACCGCAAAACTGAAAGTTACCAAAGGTG
```

-continued

GTCCGCTGCCGTTTGCATGGGATATTCTGAGTCCGCAGTTTATGTATGGTAGCAAAGCCTATGTTAAACATCCGGCA
GATATCCCGGATTATCTGAAACTGAGCTTTCCGGAAGGTTTTAAATGGGAACGTGTGATGAATTTTGAAGATGGTGG
TGTTGTTACCGTTACACAGGATAGCAGCCTGCAGGATGGTGAATTTATCTATAAAGTTAAACTGCGTGGCACGAATT
TTCCGAGTGATGGTCCGGTTATGCAGAAAAAAACCATGGGTTGGGAAGCAAGCAGCGAACGTATGTATCCGGAAGAT
GGCGCACTGAAAGGTGAAATTAAACAGCGTCTGAAGCTGAAAGATGGCGGTCATTATGATGCAGAAGTTAAAACCAC
CTACAAAGCCAAAAAACCGGTTCAGCTGCCTGGTGCATATAACGTTAACATTAAACTGGATATCACCAGCCACAACG
AGGATTATACCATTGTTGAACAGTATGAACGTGCAGAAGGTCGCCATAGTACCGGTGGTATGGATGAACTGTATAAA (Cas9-APAPAPAPAPAPAPA-mCherry chimera DNA sequence)

SEQ ID NO: 380

ATGGACAAAAAGTACTCTATTGGCCTGGATATCGGGACCAACAGCGTCGGGTGGGCTGTTATCACCGACGAGTATAA
AGTACCTTCGAAAAAGTTCAAAGTGCTGGGCAACACCGATCGCCATTCAATCAAAAAGAACTTGATTGGTGCGCTGT
TGTTTGACTCCGGGGAAACCGCCGAGGCGACTCGCCTTAAACGTACAGCACGTCGCCGGTACACTCGGCGTAAGAAT
CGCATTTGCTATTTGCAGGAAATCTTTAGCAACGAGATGGCAAAAGTCGATGACTCGTTTTTCCACCGCCTCGAGGA
AAGCTTTCTGGTGGAGGAAGACAAAAAGCATGAGCGTCACCCGATCTTCGGCAACATTGTCGATGAAGTAGCGTATC
ATGAAAAATACCCAACCATTTACCACTTACGCAAAAAGCTGGTGGACAGCACTGACAAAGCTGATTTGCGCCTTATC
TATTTAGCCCTGGCACATATGATTAAGTTTCGTGGTCACTTCCTGATCGAAGGAGACTTAAATCCCGACAACAGTGA
TGTTGATAAATTGTTTATTCAGCTTGTCCAAACTTACAATCAACTGTTCGAGGAAAACCCGATCAATGCCTCCGGTG
TGGATGCAAAAGCCATTTTAAGTGCACGCCTTAGCAAGTCCCGTCGCTTAGAAAACCTTATCGCGCAGCTGCCCGGC
GAGAAAAAGAATGGTTTGTTTGGGAACCTTATTGCCTTGAGCTTAGGCCTCACCCCGAATTTCAAAAGTAATTTCGA
TCTTGCAGAAGACGCCAAATTACAACTGTCGAAGGATACTTATGATGACGATCTCGATAATCTGTTAGCGCAGATTG
GTGACCAATACGCCGATCTTTTTCTGGCGGCTAAAAATCTGAGCGACGCCATCTTGCTTTCGGATATTCTCCGCGTT
AACACCGAAATCACGAAAGCGCCTCTTAGTGCCAGCATGATTAAACGTTATGATGAACACCACCAGGACCTGACCTT
ACTCAAAGCGTTGGTTCGCCAGCAACTGCCAGAGAAGTACAAAGAAATCTTCTTTGATCAGTCAAAGAATGGTTATG
CCGGCTATATTGACGGGGGTGCAAGCCAAGAGGAATTCTACAAATTTATCAAGCCTATTCTGGAGAAAATGGATGGC
ACCGAAGAGTTATTGGTGAAGCTTAACCGTGAAGACCTCCTGCGGAAACAGCGCACATTCGATAATGGTTCGATCCC
ACACCAAATCCATTTGGGGGAGTTACACGCTATTTTGCGTCGCCAGGAAGACTTTTACCCTTTCCTGAAGGATAACC
GGGAGAAAATTGAGAAGATCCTTACCTTTCGTATTCCGTATTACGTAGGCCCCTTAGCACGGGGTAATAGCCGTTTC
GCGTGGATGACACGGAAGTCGGAAGAGACGATCACCCCGTGGAACTTCGAAGAGGTAGTCGACAAGGGCGCATCAGC
GCAGTCTTTTATTGAACGTATGACGAATTTCGATAAAAACTTGCCCAATGAGAAGGTGCTTCCGAAACATTCCTTGT
TATATGAATATTTTACAGTTTACAACGAGCTGACCAAGGTTAAATACGTGACGGAAGGAATGCGCAAGCCCGCTTTT
CTTAGCGGTGAGCAAAAAAAGGCGATCGTCGACCTGTTATTCAAAACGAATCGTAAGGTGACTGTAAAGCAACTCAA
AGAAGATTACTTCAAAAAGATTGAGTGCTTCGACAGCGTCGAAATCTCTGGGGTAGAGGATCGGTTTAACGCAAGTT
TAGGTACCTACCATGACCTGCTTAAAATCATTAAGGATAAAGACTTCTTAGATAATGAAGAGAACGAAGATATTCTC
GAGGACATCGTCTTGACGTTAACCTTATTTGAGGATCGTGAAATGATTGAGGAACGCCTCAAAACTTATGCCCACCT
GTTCGACGATAAGGTGATGAAGCAGCTGAAACGTCGGCGCTACACAGGATGGGGCCGCTTGAGTCGCAAACTTATTA
ACGGAATCCGTGACAAGCAATCCGGCAAAACGATTCTGGATTTCTTGAAGTCGGACGGATTTGCTAATCGCAACTTC
ATGCAGTTGATCCATGATGACTCCCTGACTTTTAAAGAGGATATTCAAAAGGCGCAGGTTAGTGGTCAAGGCGACAG
CTTACACGAACACATCGCAAATTTGGCTGGTTCGCCGGCCATTAAAAAGGGGATCCTCCAGACCGTGAAAGTTGTAG
ATGAGCTTGTTAAGGTCATGGGTCGTCATAAGCCCGAAAACATCGTGATTGAAATGGCGCGGGAGAATCAAACGACC
CAGAAAGGACAAAAGAATAGCCGTGAACGGATGAAGCGGATCGAGGAAGGCATTAAAGAGCTGGGGTCTCAAATCTT
GAAGGAACACCCTGTGGAGAACACTCAGCTCCAAAATGAAAAACTTTACCTGTACTATTTGCAGAACGGACGCGATA
TGTACGTGGACCAAGAGTTGGATATTAATCGGCTGAGTGACTACGACGTTGATCATATCGTCCCGCAGAGCTTCCTC

-continued

```
AAAGACGATTCTATTGACAATAAGGTACTGACGCGCTCTGATAAAAACCGTGGTAAGTCGGACAACGTGCCCTCCGA
AGAGGTTGTGAAAAAGATGAAAAATTATTGGCGCCAGCTTTTAAACGCGAAGCTGATCACACAACGTAAATTCGATA
ATTTGACCAAGGCTGAACGGGGTGGCCTGAGCGAGTTAGATAAGGCAGGATTTATTAAACGCCAGTTAGTGGAGACT
CGTCAAATCACCAAACATGTCGCGCAGATTTTGGACAGCCGGATGAACACCAAGTACGATGAAAATGACAAACTGAT
CCGTGAGGTGAAAGTCATTACTCTGAAGTCCAAATTAGTTAGTGATTTCCGGAAGGACTTTCAATTCTACAAAGTCC
GTGAAATTAATAACTATCATCACGCACATGACGCGTACCTGAATGCAGTGGTTGGGACCGCCCTTATCAAGAAATAT
CCTAAGCTGGAGTCGGAGTTTGTCTATGGCGACTATAAGGTATACGATGTTCGCAAAATGATTGCGAAATCTGAGCA
GGAGATCGGTAAGGCAACCGCAAAATATTTCTTTTACTCAAACATTATGAATTTCTTTAAGACAGAAATCACTCTGG
CCAACGGGGAGATTCGCAAACGTCCGTTGATCGAAACAAACGGCGAGACTGGCGAAATTGTTTGGGACAAAGGGCGT
GATTTCGCGACGGTGCGCAAGGTACTGAGCATGCCTCAAGTCAATATTGTTAAGAAAACCGAAGTGCAGACGGGCGG
GTTTTCCAAGGAAAGCATCTTACCCAAACGTAATTCAGATAAACTTATTGCACGCAAAAAGGACTGGGATCCGAAAA
AGTATGGAGGCTTCGACAGTCCAACCGTAGCCTACTCTGTTCTCGTTGTAGCGAAAGTAGAAAAGGGTAAATCCAAG
AAACTGAAATCTGTCAAGGAGTTGCTTGGAATCACCATTATGGAGCGTAGCTCCTTCGAGAAGAACCCGATTGACTT
TCTGGAAGCCAAAGGATATAAAGAGGTCAAGAAAGATCTTATCATTAAGCTGCCTAAGTATTCACTCTTCGAGCTGG
AAAATGGTCGTAAACGCATGCTCGCTTCTGCCGGCGAGTTGCAGAAGGGCAATGAATTAGCACTTCCATCAAAGTAC
GTTAACTTCCTGTATTTGGCCAGCCATTACGAGAAACTGAAGGGGTCTCCAGAGGACAACGAACAGAAACAATTATT
TGTAGAGCAGCACAAGCATTATCTTGATGAAATCATTGAGCAAATTTCCGAATTCAGTAAACGCGTAATCCTGGCCG
ATGCAAACCTCGACAAGGTGCTGAGCGCTTACAATAAGCATCGCGACAAACCTATCCGTGAGCAGGCTGAAAATATC
ATTCACCTGTTCACATTAACGAACCTGGGCGCTCCGGCCGCTTTTAAATATTTCGACACGACAATCGACCGTAAGCG
CTATACCAGTACGAAAGAAGTGTTGGATGCGACCCTTATTCACCAGTCAATTACAGGATTATATGAGACCCGTATCG
ACCTTAGCCAATTAGGTGGGGATGCGCCAGCGCCTGCTCCTGCACCCGCTCCAGCTCCTGCCCCAGCGATGGTGAGC
AAAGGTGAAGAGGATAATATGGCCATCATCAAAGAATTCATGCGCTTCAAAGTTCATATGGAAGGTAGCGTTAATGG
CCACGAATTTGAAATTGAAGGTGAAGGCGAAGGTCGTCCGTATGAAGGCACCCAGACCGCAAAACTGAAAGTTACCA
AAGGTGGTCCGCTGCCGTTTGCATGGGATATTCTGAGTCCGCAGTTTATGTATGGTAGCAAAGCCTATGTTAAACAT
CCGGCAGATATCCCGGATTATCTGAAACTGAGCTTTCCGGAAGGTTTTAAATGGGAACGTGTGATGAATTTTGAAGA
TGGTGGTGTTGTTACCGTTACACAGGATAGCAGCCTGCAGGATGGTGAATTTATCTATAAAGTTAAACTGCGTGGCA
CGAATTTTCCGAGTGATGGTCCGGTTATGCAGAAAAAAACCATGGGTTGGGAAGCAAGCAGCGAACGTATGTATCCG
GAAGATGGCGCACTGAAAGGTGAAATTAAACAGCGTCTGAAGCTGAAAGATGGCGGTCATTATGATGCAGAAGTTAA
AACCACCTACAAAGCCAAAAAACCGGTTCAGCTGCCTGGTGCATATAACGTTAACATTAAACTGGATATCACCAGCC
ACAACGAGGATTATACCATTGTTGAACAGTATGAACGTGCAGAAGGTCGCCATAGTACCGGTGGTATGGATGAACTG
TATAAA
```

(Cas9-APAPAPAPAPAPAPAPAPA-mCherry chimera DNA sequence)

SEQ ID NO: 381

```
ATGGACAAAAAGTACTCTATTGGCCTGGATATCGGGACCAACAGCGTCGGGTGGGCTGTTATCACCGACGAGTATAA
AGTACCTTCGAAAAAGTTCAAAGTGCTGGGCAACACCGATCGCCATTCAATCAAAAAGAACTTGATTGGTGCGCTGT
TGTTTGACTCCGGGGAAACCGCCGAGGCGACTCGCCTTAAACGTACAGCACGTCGCCGGTACACTCGGCGTAAGAAT
CGCATTTGCTATTTGCAGGAAATCTTTAGCAACGAGATGGCAAAAGTCGATGACTCGTTTTTCCACCGCCTCGAGGA
AAGCTTTCTGGTGGAGGAAGACAAAAAGCATGAGCGTCACCCGATCTTCGGCAACATTGTCGATGAAGTAGCGTATC
ATGAAAAATACCCAACCATTTACCACTTACGCAAAAAGCTGGTGGACAGCACTGACAAAGCTGATTTGCGCCTTATC
TATTTAGCCCTGGCACATATGATTAAGTTTCGTGGTCACTTCCTGATCGAAGGAGACTTAAATCCCGACAACAGTGA
TGTTGATAAATTGTTTATTCAGCTTGTCCAAACTTACAATCAACTGTTCGAGGAAAACCCGATCAATGCCTCCGGTG
```

-continued

```
TGGATGCAAAAGCCATTTTAAGTGCACGCCTTAGCAAGTCCCGTCGCTTAGAAAACCTTATCGCGCAGCTGCCCGGC
GAGAAAAAGAATGGTTTGTTTGGGAACCTTATTGCCTTGAGCTTAGGCCTCACCCCGAATTTCAAAAGTAATTTCGA
TCTTGCAGAAGACGCCAAATTACAACTGTCGAAGGATACTTATGATGACGATCTCGATAATCTGTTAGCGCAGATTG
GTGACCAATACGCCGATCTTTTTCTGGCGGCTAAAAATCTGAGCGACGCCATCTTGCTTTCGGATATTCTCCGCGTT
AACACCGAAATCACGAAAGCGCCTCTTAGTGCCAGCATGATTAAACGTTATGATGAACACCACCAGGACCTGACCTT
ACTCAAAGCGTTGGTTCGCCAGCAACTGCCAGAGAAGTACAAAGAAATCTTCTTTGATCAGTCAAAGAATGGTTATG
CCGGCTATATTGACGGGGGTGCAAGCCAAGAGGAATTCTACAAATTTATCAAGCCTATTCTGGAGAAAATGGATGGC
ACCGAAGAGTTATTGGTGAAGCTTAACCGTGAAGACCTCCTGCGGAAACAGCGCACATTCGATAATGGTTCGATCCC
ACACCAAATCCATTTGGGGGAGTTACACGCTATTTTGCGTCGCCAGGAAGACTTTTACCCTTTCCTGAAGGATAACC
GGGAGAAAATTGAGAAGATCCTTACCTTTCGTATTCCGTATTACGTAGGCCCCTTAGCACGGGGTAATAGCCGTTTC
GCGTGGATGACACGGAAGTCGGAAGAGACGATCACCCCGTGGAACTTCGAAGAGGTAGTCGACAAGGGCGCATCAGC
GCAGTCTTTTATTGAACGTATGACGAATTTCGATAAAAACTTGCCCAATGAGAAGGTGCTTCCGAAACATTCCTTGT
TATATGAATATTTTACAGTTTACAACGAGCTGACCAAGGTTAAATACGTGACGGAAGGAATGCGCAAGCCCGCTTTT
CTTAGCGGTGAGCAAAAAAGGCGATCGTCGACCTGTTATTCAAAACGAATCGTAAGGTGACTGTAAAGCAACTCAA
AGAAGATTACTTCAAAAAGATTGAGTGCTTCGACAGCGTCGAAATCTCTGGGGTAGAGGATCGGTTTAACGCAAGTT
TAGGTACCTACCATGACCTGCTTAAAATCATTAAGGATAAAGACTTCTTAGATAATGAAGAGAACGAAGATATTCTC
GAGGACATCGTCTTGACGTTAACCTTATTTGAGGATCGTGAAATGATTGAGGAACGCCTCAAAACTTATGCCCACCT
GTTCGACGATAAGGTGATGAAGCAGCTGAAACGTCGGCGCTACACAGGATGGGGCCGCTTGAGTCGCAAACTTATTA
ACGGAATCCGTGACAAGCAATCCGGCAAAACGATTCTGGATTTCTTGAAGTCGGACGGATTTGCTAATCGCAACTTC
ATGCAGTTGATCCATGATGACTCCCTGACTTTTAAAGAGGATATTCAAAAGGCGCAGGTTAGTGGTCAAGGCGACAG
CTTACACGAACACATCGCAAATTTGGCTGGTTCGCCGGCCATTAAAAAGGGGATCCTCCAGACCGTGAAAGTTGTAG
ATGAGCTTGTTAAGGTCATGGGTCGTCATAAGCCCGAAAACATCGTGATTGAAATGGCGCGGGAGAATCAAACGACC
CAGAAAGGACAAAAGAATAGCCGTGAACGGATGAAGCGGATCGAGGAAGGCATTAAAGAGCTGGGGTCTCAAATCTT
GAAGGAACACCCTGTGGAGAACACTCAGCTCCAAAATGAAAAACTTTACCTGTACTATTTGCAGAACGGACGCGATA
TGTACGTGGACCAAGAGTTGGATATTAATCGGCTGAGTGACTACGACGTTGATCATATCGTCCCGCAGAGCTTCCTC
AAAGACGATTCTATTGACAATAAGGTACTGACGCGCTCTGATAAAAACCGTGGTAAGTCGGACAACGTGCCCTCCGA
AGAGGTTGTGAAAAAGATGAAAAATTATTGGCGCCAGCTTTTAAACGCGAAGCTGATCACACAACGTAAATTCGATA
ATTTGACCAAGGCTGAACGGGGTGGCCTGAGCGAGTTAGATAAGGCAGGATTTATTAAACGCCAGTTAGTGGAGACT
CGTCAAATCACCAAACATGTCGCGCAGATTTTGGACAGCCGGATGAACACCAAGTACGATGAAAATGACAAACTGAT
CCGTGAGGTGAAAGTCATTACTCTGAAGTCCAAATTAGTTAGTGATTTCCGGAAGGACTTTCAATTCTACAAAGTCC
GTGAAATTAATAACTATCATCACGCACATGACGCGTACCTGAATGCAGTGGTTGGGACCGCCCTTATCAAGAAATAT
CCTAAGCTGGAGTCGGAGTTTGTCTATGGCGACTATAAGGTATACGATGTTCGCAAAATGATTGCGAAATCTGAGCA
GGAGATCGGTAAGGCAACCGCAAAATATTTCTTTTACTCAAACATTATGAATTTCTTTAAGACAGAAATCACTCTGG
CCAACGGGGAGATTCGCAAACGTCCGTTGATCGAAACAAACGGCGAGACTGGCGAAATTGTTTGGGACAAAGGGCGT
GATTTCGCGACGGTGCGCAAGGTACTGAGCATGCCTCAAGTCAATATTGTTAAGAAAACCGAAGTGCAGACGGGCGG
GTTTTCCAAGGAAAGCATCTTACCCAAACGTAATTCAGATAAACTTATTGCACGCAAAAAGGACTGGGATCCGAAAA
AGTATGGAGGCTTCGACAGTCCAACCGTAGCCTACTCTGTTCTCGTTGTAGCGAAAGTAGAAAAGGGTAAATCCAAG
AAACTGAAATCTGTCAAGGAGTTGCTTGGAATCACCATTATGGAGCGTAGCTCCTTCGAGAAGAACCCGATTGACTT
TCTGGAAGCCAAAGGATATAAAGAGGTCAAGAAAGATCTTATCATTAAGCTGCCTAAGTATTCACTCTTCGAGCTGG
AAAATGGTCGTAAACGCATGCTCGCTTCTGCCGGCGAGTTGCAGAAGGGCAATGAATTAGCACTTCCATCAAAGTAC
GTTAACTTCCTGTATTTGGCCAGCCATTACGAGAAACTGAAGGGGTCTCCAGAGGACAACGAACAGAAACAATTATT
```

-continued

TGTAGAGCAGCACAAGCATTATCTTGATGAAATCATTGAGCAAATTTCCGAATTCAGTAAACGCGTAATCCTGGCCG

ATGCAAACCTCGACAAGGTGCTGAGCGCTTACAATAAGCATCGCGACAAACCTATCCGTGAGCAGGCTGAAAATATC

ATTCACCTGTTCACATTAACGAACCTGGGCGCTCCGGCCGCTTTTAAATATTTCGACACGACAATCGACCGTAAGCG

CTATACCAGTACGAAAGAAGTGTTGGATGCGACCCTTATTCACCAGTCAATTACAGGATTATATGAGACCCGTATCG

ACCTTAGCCAATTAGGTGGGGATGCGCCAGCGCCTGCTCCTGCACCCGCTCCAGCGCCAGCTCCTGCACCTGCGATG

GTGAGCAAAGGTGAAGAGGATAATATGGCCATCATCAAAGAATTCATGCGCTTCAAAGTTCATATGGAAGGTAGCGT

TAATGGCCACGAATTTGAAATTGAAGGTGAAGGCGAAGGTCGTCCGTATGAAGGCACCCAGACCGCAAAACTGAAAG

TTACCAAAGGTGGTCCGCTGCCGTTTGCATGGGATATTCTGAGTCCGCAGTTTATGTATGGTAGCAAAGCCTATGTT

AAACATCCGGCAGATATCCCGGATTATCTGAAACTGAGCTTTCCGGAAGGTTTTAAATGGGAACGTGTGATGAATTT

TGAAGATGGTGGTGTTGTTACCGTTACACAGGATAGCAGCCTGCAGGATGGTGAATTTATCTATAAAGTTAAACTGC

GTGGCACGAATTTTCCGAGTGATGGTCCGGTTATGCAGAAAAAAACCATGGGTTGGGAAGCAAGCAGCGAACGTATG

TATCCGGAAGATGGCGCACTGAAAGGTGAAATTAAACAGCGTCTGAAGCTGAAAGATGGCGGTCATTATGATGCAGA

AGTTAAAACCACCTACAAAGCCAAAAAACCGGTTCAGCTGCCTGGTGCATATAACGTTAACATTAAACTGGATATCA

CCAGCCACAACGAGGATTATACCATTGTTGAACAGTATGAACGTGCAGAAGGTCGCCATAGTACCGGTGGTATGGAT

GAACTGTATAAA (Cas9-APAPAPAPAPAPAPAPAPAPA-mCherry chimera DNA sequence)

SEQ ID NO: 382

ATGGACAAAAAGTACTCTATTGGCCTGGATATCGGGACCAACAGCGTCGGGTGGCTGTTATCACCGACGAGTATAA

AGTACCTTCGAAAAAGTTCAAAGTGCTGGGCAACACCGATCGCCATTCAATCAAAAAGAACTTGATTGGTGCGCTGT

TGTTTGACTCCGGGGAAACCGCCGAGGCGACTCGCCTTAAACGTACAGCACGTCGCCGGTACACTCGGCGTAAGAAT

CGCATTTGCTATTTGCAGGAAATCTTTAGCAACGAGATGGCAAAAGTCGATGACTCGTTTTTCCACCGCCTCGAGGA

AAGCTTTCTGGTGGAGGAAGACAAAAAGCATGAGCGTCACCCGATCTTCGGCAACATTGTCGATGAAGTAGCGTATC

ATGAAAAATACCCAACCATTTACCACTTACGCAAAAAGCTGGTGGACAGCACTGACAAAGCTGATTTGCGCCTTATC

TATTTAGCCCTGGCACATATGATTAAGTTTCGTGGTCACTTCCTGATCGAAGGAGACTTAAATCCCGACAACAGTGA

TGTTGATAAATTGTTTATTCAGCTTGTCCAAACTTACAATCAACTGTTCGAGGAAAACCCGATCAATGCCTCCGGTG

TGGATGCAAAAGCCATTTTAAGTGCACGCCTTAGCAAGTCCCGTCGCTTAGAAAACCTTATCGCGCAGCTGCCCGGC

GAGAAAAAGAATGGTTTGTTTGGGAACCTTATTGCCTTGAGCTTAGGCCTCACCCCGAATTTCAAAAGTAATTTCGA

TCTTGCAGAAGACGCCAAATTACAACTGTCGAAGGATACTTATGATGACGATCTCGATAATCTGTTAGCGCAGATTG

GTGACCAATACGCCGATCTTTTTCTGGCGGCTAAAAATCTGAGCGACGCCATCTTGCTTTCGGATATTCTCCGCGTT

AACACCGAAATCACGAAAGCGCCTCTTAGTGCCAGCATGATTAAACGTTATGATGAACACCACCAGGACCTGACCTT

ACTCAAAGCGTTGGTTCGCCAGCAACTGCCAGAGAAGTACAAAGAAATCTTCTTTGATCAGTCAAAGAATGGTTATG

CCGGCTATATTGACGGGGGTGCAAGCCAAGAGGAATTCTACAAATTTATCAAGCCTATTCTGGAGAAAATGGATGGC

ACCGAAGAGTTATTGGTGAAGCTTAACCGTGAAGACCTCCTGCGGAAACAGCGCACATTCGATAATGGTTCGATCCC

ACACCAAATCCATTTGGGGGAGTTACACGCTATTTTGCGTCGCCAGGAAGACTTTTACCCTTTCCTGAAGGATAACC

GGGAGAAAATTGAGAAGATCCTTACCTTTCGTATTCCGTATTACGTAGGCCCCTTAGCACGGGGTAATAGCCGTTTC

GCGTGGATGACACGGAAGTCGGAAGAGACGATCACCCCGTGGAACTTCGAAGAGGTAGTCGACAAGGGCGCATCAGC

GCAGTCTTTTATTGAACGTATGACGAATTTCGATAAAAACTTGCCCAATGAGAAGGTGCTTCCGAAACATTCCTTGT

TATATGAATATTTTACAGTTTACAACGAGCTGACCAAGGTTAAATACGTGACGGAAGGAATGCGCAAGCCCGCTTTT

CTTAGCGGTGAGCAAAAAAAGGCGATCGTCGACCTGTTATTCAAAACGAATCGTAAGGTGACTGTAAAGCAACTCAA

AGAAGATTACTTCAAAAAGATTGAGTGCTTCGACAGCGTCGAAATCTCTGGGGTAGAGGATCGGTTTAACGCAAGTT

TAGGTACCTACCATGACCTGCTTAAAATCATTAAGGATAAAGACTTCTTAGATAATGAAGAGAACGAAGATATTCTC

-continued

```
GAGGACATCGTCTTGACGTTAACCTTATTTGAGGATCGTGAAATGATTGAGGAACGCCTCAAAACTTATGCCCACCT
GTTCGACGATAAGGTGATGAAGCAGCTGAAACGTCGGCGCTACACAGGATGGGGCCGCTTGAGTCGCAAACTTATTA
ACGGAATCCGTGACAAGCAATCCGGCAAAACGATTCTGGATTTCTTGAAGTCGGACGGATTTGCTAATCGCAACTTC
ATGCAGTTGATCCATGATGACTCCCTGACTTTTAAAGAGGATATTCAAAAGGCGCAGGTTAGTGGTCAAGGCGACAG
CTTACACGAACACATCGCAAATTTGGCTGGTTCGCCGGCCATTAAAAAGGGGATCCTCCAGACCGTGAAAGTTGTAG
ATGAGCTTGTTAAGGTCATGGGTCGTCATAAGCCCGAAAACATCGTGATTGAAATGGCGCGGGAGAATCAAACGACC
CAGAAAGGACAAAAGAATAGCCGTGAACGGATGAAGCGGATCGAGGAAGGCATTAAAGAGCTGGGGTCTCAAATCTT
GAAGGAACACCCTGTGGAGAACACTCAGCTCCAAAATGAAAAACTTTACCTGTACTATTTGCAGAACGGACGCGATA
TGTACGTGGACCAAGAGTTGGATATTAATCGGCTGAGTGACTACGACGTTGATCATATCGTCCCGCAGAGCTTCCTC
AAAGACGATTCTATTGACAATAAGGTACTGACGCGCTCTGATAAAAACCGTGGTAAGTCGGACAACGTGCCCTCCGA
AGAGGTTGTGAAAAAGATGAAAAATTATTGGCGCCAGCTTTTAAACGCGAAGCTGATCACACAACGTAAATTCGATA
ATTTGACCAAGGCTGAACGGGGTGGCCTGAGCGAGTTAGATAAGGCAGGATTTATTAAACGCCAGTTAGTGGAGACT
CGTCAAATCACCAAACATGTCGCGCAGATTTTGGACAGCCGGATGAACACCAAGTACGATGAAAATGACAAACTGAT
CCGTGAGGTGAAAGTCATTACTCTGAAGTCCAAATTAGTTAGTGATTTCCGGAAGGACTTTCAATTCTACAAAGTCC
GTGAAATTAATAACTATCATCACGCACATGACGCGTACCTGAATGCAGTGGTTGGGACCGCCCTTATCAAGAAATAT
CCTAAGCTGGAGTCGGAGTTTGTCTATGGCGACTATAAGGTATACGATGTTCGCAAAATGATTGCGAAATCTGAGCA
GGAGATCGGTAAGGCAACCGCAAAATATTTCTTTTACTCAAACATTATGAATTTCTTTAAGACAGAAATCACTCTGG
CCAACGGGGAGATTCGCAAACGTCCGTTGATCGAAACAAACGGCGAGACTGGCGAAATTGTTTGGGACAAAGGGCGT
GATTTCGCGACGGTGCGCAAGGTACTGAGCATGCCTCAAGTCAATATTGTTAAGAAAACCGAAGTGCAGACGGGCGG
GTTTTCCAAGGAAAGCATCTTACCCAAACGTAATTCAGATAAACTTATTGCACGCAAAAAGGACTGGGATCCGAAAA
AGTATGGAGGCTTCGACAGTCCAACCGTAGCCTACTCTGTTCTCGTTGTAGCGAAAGTAGAAAAGGGTAAATCCAAG
AAACTGAAATCTGTCAAGGAGTTGCTTGGAATCACCATTATGGAGCGTAGCTCCTTCGAGAAGAACCCGATTGACTT
TCTGGAAGCCAAAGGATATAAAGAGGTCAAGAAAGATCTTATCATTAAGCTGCCTAAGTATTCACTCTTCGAGCTGG
AAAATGGTCGTAAACGCATGCTCGCTTCTGCCGGCGAGTTGCAGAAGGGCAATGAATTAGCACTTCCATCAAAGTAC
GTTAACTTCCTGTATTTGGCCAGCCATTACGAGAAACTGAAGGGGTCTCCAGAGGACAACGAACAGAAACAATTATT
TGTAGAGCAGCACAAGCATTATCTTGATGAAATCATTGAGCAAATTTCCGAATTCAGTAAACGCGTAATCCTGGCCG
ATGCAAACCTCGACAAGGTGCTGAGCGCTTACAATAAGCATCGCGACAAACCTATCCGTGAGCAGGCTGAAAATATC
ATTCACCTGTTCACATTAACGAACCTGGGCGCTCCGGCCGCTTTTAAATATTTCGACACGACAATCGACCGTAAGCG
CTATACCAGTACGAAAGAAGTGTTGGATGCGACCCTTATTCACCAGTCAATTACAGGATTATATGAGACCCGTATCG
ACCTTAGCCAATTAGGTGGGGATGCGCCAGCGCCTGCTCCTGCACCCGCTCCAGCTCCTGCGCCAGCTCCTGCACCT
GCGATGGTGAGCAAAGGTGAAGAGGATAATATGGCCATCATCAAAGAATTCATGCGCTTCAAAGTTCATATGGAAGG
TAGCGTTAATGGCCACGAATTTGAAATTGAAGGTGAAGGCGAAGGTCGTCCGTATGAAGGCACCCAGACCGCAAAAC
TGAAAGTTACCAAAGGTGGTCCGCTGCCGTTTGCATGGGATATTCTGAGTCCGCAGTTTATGTATGGTAGCAAAGCC
TATGTTAAACATCCGGCAGATATCCCGGATTATCTGAAACTGAGCTTTCCGGAAGGTTTTAAATGGGAACGTGTGAT
GAATTTTGAAGATGGTGGTGTTGTTACCGTTACACAGGATAGCAGCCTGCAGGATGGTGAATTTATCTATAAAGTTA
AACTGCGTGGCACGAATTTTCCGAGTGATGGTCCGGTTATGCAGAAAAAAACCATGGGTTGGGAAGCAAGCAGCGAA
CGTATGTATCCGGAAGATGGCGCACTGAAAGGTGAAATTAAACAGCGTCTGAAGCTGAAAGATGGCGGTCATTATGA
TGCAGAAGTTAAAACCACCTACAAAGCCAAAAAACCGGTTCAGCTGCCTGGTGCATATAACGTTAACATTAAACTGG
ATATCACCAGCCACAACGAGGATTATACCATTGTTGAACAGTATGAACGTGCAGAAGGTCGCCATAGTACCGGTGGT
ATGGATGAACTGTATAAA
```

(Cas9-APAPAPAPAPAPAPAPAPAPAPA-mCherry chimera DNA sequence)
SEQ ID NO: 383

ATGGACAAAAAGTACTCTATTGGCCTGGATATCGGGACCAACAGCGTCGGGTGGGCTGTTATCACCGACGAGTATAA
AGTACCTTCGAAAAAGTTCAAAGTGCTGGGCAACACCGATCGCCATTCAATCAAAAAGAACTTGATTGGTGCGCTGT
TGTTTGACTCCGGGGAAACCGCCGAGGCGACTCGCCTTAAACGTACAGCACGTCGCCGGTACACTCGGCGTAAGAAT
CGCATTTGCTATTTGCAGGAAATCTTTAGCAACGAGATGGCAAAAGTCGATGACTCGTTTTTCCACCGCCTCGAGGA
AAGCTTTCTGGTGGAGGAAGACAAAAAGCATGAGCGTCACCCGATCTTCGGCAACATTGTCGATGAAGTAGCGTATC
ATGAAAAATACCCAACCATTTACCACTTACGCAAAAAGCTGGTGGACAGCACTGACAAAGCTGATTTGCGCCTTATC
TATTTAGCCCTGGCACATATGATTAAGTTTCGTGGTCACTTCCTGATCGAAGGAGACTTAAATCCCGACAACAGTGA
TGTTGATAAATTGTTTATTCAGCTTGTCCAAACTTACAATCAACTGTTCGAGGAAAACCCGATCAATGCCTCCGGTG
TGGATGCAAAAGCCATTTTAAGTGCACGCCTTAGCAAGTCCCGTCGCTTAGAAAACCTTATCGCGCAGCTGCCCGGC
GAGAAAAAGAATGGTTTGTTTGGGAACCTTATTGCCTTGAGCTTAGGCCTCACCCCGAATTTCAAAAGTAATTTCGA
TCTTGCAGAAGACGCCAAATTACAACTGTCGAAGGATACTTATGATGACGATCTCGATAATCTGTTAGCGCAGATTG
GTGACCAATACGCCGATCTTTTTCTGGCGGCTAAAAATCTGAGCGACGCCATCTTGCTTTCGGATATTCTCCGCGTT
AACACCGAAATCACGAAAGCGCCTCTTAGTGCCAGCATGATTAAACGTTATGATGAACACCACCAGGACCTGACCTT
ACTCAAAGCGTTGGTTCGCCAGCAACTGCCAGAGAAGTACAAAGAAATCTTCTTTGATCAGTCAAAGAATGGTTATG
CCGGCTATATTGACGGGGGTGCAAGCCAAGAGGAATTCTACAAATTTATCAAGCCTATTCTGGAGAAAATGGATGGC
ACCGAAGAGTTATTGGTGAAGCTTAACCGTGAAGACCTCCTGCGGAAACAGCGCACATTCGATAATGGTTCGATCCC
ACACCAAATCCATTTGGGGGAGTTACACGCTATTTTGCGTCGCCAGGAAGACTTTTACCCTTTCCTGAAGGATAACC
GGGAGAAAATTGAGAAGATCCTTACCTTTCGTATTCCGTATTACGTAGGCCCCTTAGCACGGGGTAATAGCCGTTTC
GCGTGGATGACACGGAAGTCGGAAGAGACGATCACCCCGTGGAACTTCGAAGAGGTAGTCGACAAGGGCGCATCAGC
GCAGTCTTTTATTGAACGTATGACGAATTTCGATAAAAACTTGCCCAATGAGAAGGTGCTTCCGAAACATTCCTTGT
TATATGAATATTTTACAGTTTACAACGAGCTGACCAAGGTTAAATACGTGACGGAAGGAATGCGCAAGCCCGCTTTT
CTTAGCGGTGAGCAAAAAAGGCGATCGTCGACCTGTTATTCAAAACGAATCGTAAGGTGACTGTAAAGCAACTCAA
AGAAGATTACTTCAAAAAGATTGAGTGCTTCGACAGCGTCGAAATCTCTGGGGTAGAGGATCGGTTTAACGCAAGTT
TAGGTACCTACCATGACCTGCTTAAAATCATTAAGGATAAAGACTTCTTAGATAATGAAGAGAACGAAGATATTCTC
GAGGACATCGTCTTGACGTTAACCTTATTTGAGGATCGTGAAATGATTGAGGAACGCCTCAAAACTTATGCCCACCT
GTTCGACGATAAGGTGATGAAGCAGCTGAAACGTCGGCGCTACACAGGATGGGGCCGCTTGAGTCGCAAACTTATTA
ACGGAATCCGTGACAAGCAATCCGGCAAAACGATTCTGGATTTCTTGAAGTCGGACGGATTTGCTAATCGCAACTTC
ATGCAGTTGATCCATGATGACTCCCTGACTTTTAAAGAGGATATTCAAAAGGCGCAGGTTAGTGGTCAAGGCGACAG
CTTACACGAACACATCGCAAATTTGGCTGGTTCGCCGGCCATTAAAAAGGGGATCCTCCAGACCGTGAAAGTTGTAG
ATGAGCTTGTTAAGGTCATGGGTCGTCATAAGCCCGAAAACATCGTGATTGAAATGGCGCGGGAGAATCAAACGACC
CAGAAAGGACAAAAGAATAGCCGTGAACGGATGAAGCGGATCGAGGAAGGCATTAAAGAGCTGGGGTCTCAAATCTT
GAAGGAACACCCTGTGGAGAACACTCAGCTCCAAAATGAAAAACTTTACCTGTACTATTTGCAGAACGGACGCGATA
TGTACGTGGACCAAGAGTTGGATATTAATCGGCTGAGTGACTACGACGTTGATCATATCGTCCCGCAGAGCTTCCTC
AAAGACGATTCTATTGACAATAAGGTACTGACGCGCTCTGATAAAAACCGTGGTAAGTCGGACAACGTGCCCTCCGA
AGAGGTTGTGAAAAAGATGAAAAATTATTGGCGCCAGCTTTTAAACGCGAAGCTGATCACACAACGTAAATTCGATA
ATTTGACCAAGGCTGAACGGGGTGGCCTGAGCGAGTTAGATAAGGCAGGATTTATTAAACGCCAGTTAGTGGAGACT
CGTCAAATCACCAAACATGTCGCGCAGATTTTGGACAGCCGGATGAACACCAAGTACGATGAAAATGACAAACTGAT
CCGTGAGGTGAAAGTCATTACTCTGAAGTCCAAATTAGTTAGTGATTTCCGAAGGACTTTCAATTCTACAAAGTCC
GTGAAATTAATAACTATCATCACGCACATGACGCGTACCTGAATGCAGTGGTTGGGACCGCCCTTATCAAGAAATAT

-continued

CCTAAGCTGGAGTCGGAGTTTGTCTATGGCGACTATAAGGTATACGATGTTCGCAAAATGATTGCGAAATCTGAGCA

GGAGATCGGTAAGGCAACCGCAAAATATTTCTTTTACTCAAACATTATGAATTTCTTTAAGACAGAAATCACTCTGG

CCAACGGGGAGATTCGCAAACGTCCGTTGATCGAAACAAACGGCGAGACTGGCGAAATTGTTTGGGACAAAGGGCGT

GATTTCGCGACGGTGCGCAAGGTACTGAGCATGCCTCAAGTCAATATTGTTAAGAAAACCGAAGTGCAGACGGGCGG

GTTTTCCAAGGAAAGCATCTTACCCAAACGTAATTCAGATAAACTTATTGCACGCAAAAAGGACTGGGATCCGAAAA

AGTATGGAGGCTTCGACAGTCCAACCGTAGCCTACTCTGTTCTCGTTGTAGCGAAAGTAGAAAAGGGTAAATCCAAG

AAACTGAAATCTGTCAAGGAGTTGCTTGGAATCACCATTATGGAGCGTAGCTCCTTCGAGAAGAACCCGATTGACTT

TCTGGAAGCCAAAGGATATAAAGAGGTCAAGAAAGATCTTATCATTAAGCTGCCTAAGTATTCACTCTTCGAGCTGG

AAAATGGTCGTAAACGCATGCTCGCTTCTGCCGGCGAGTTGCAGAAGGGCAATGAATTAGCACTTCCATCAAAGTAC

GTTAACTTCCTGTATTTGGCCAGCCATTACGAGAAACTGAAGGGGTCTCCAGAGGACAACGAACAGAAACAATTATT

TGTAGAGCAGCACAAGCATTATCTTGATGAAATCATTGAGCAAATTTCCGAATTCAGTAAACGCGTAATCCTGGCCG

ATGCAAACCTCGACAAGGTGCTGAGCGCTTACAATAAGCATCGCGACAAACCTATCCGTGAGCAGGCTGAAAATATC

ATTCACCTGTTCACATTAACGAACCTGGGCGCTCCGGCCGCTTTTAAATATTTCGACACGACAATCGACCGTAAGCG

CTATACCAGTACGAAAGAAGTGTTGGATGCGACCCTTATTCACCAGTCAATTACAGGATTATATGAGACCCGTATCG

ACCTTAGCCAATTAGGTGGGGATGCGCCAGCGCCTGCTCCTGCACCCGCTCCAGCTCCTGCTCCTGCGCCAGCTCCT

GCACCTGCGATGGTGAGCAAAGGTGAAGAGGATAATATGGCCATCATCAAAGAATTCATGCGCTTCAAAGTTCATAT

GGAAGGTAGCGTTAATGGCCACGAATTTGAAATTGAAGGTGAAGGCGAAGGTCGTCCGTATGAAGGCACCCAGACCG

CAAAACTGAAAGTTACCAAAGGTGGTCCGCTGCCGTTTGCATGGGATATTCTGAGTCCGCAGTTTATGTATGGTAGC

AAAGCCTATGTTAAACATCCGGCAGATATCCCGGATTATCTGAAACTGAGCTTTCCGGAAGGTTTTAAATGGGAACG

TGTGATGAATTTTGAAGATGGTGGTGTTGTTACCGTTACACAGGATAGCAGCCTGCAGGATGGTGAATTTATCTATA

AAGTTAAACTGCGTGGCACGAATTTTCCGAGTGATGGTCCGGTTATGCAGAAAAAAACCATGGGTTGGGAAGCAAGC

AGCGAACGTATGTATCCGGAAGATGGCGCACTGAAAGGTGAAATTAAACAGCGTCTGAAGCTGAAAGATGGCGGTCA

TTATGATGCAGAAGTTAAAACCACCTACAAAGCCAAAAAACCGGTTCAGCTGCCTGGTGCATATAACGTTAACATTA

AACTGGATATCACCAGCCACAACGAGGATTATACCATTGTTGAACAGTATGAACGTGCAGAAGGTCGCCATAGTACC

GGTGGTATGGATGAACTGTATAAA (Cas9-APAPAPAPAPAPAPAPAPAPAPAPA-mCherry chimera DNA sequence)

SEQ ID NO: 384

ATGGACAAAAAGTACTCTATTGGCCTGGATATCGGGACCAACAGCGTCGGGTGGGCTGTTATCACCGACGAGTATAA

AGTACCTTCGAAAAAGTTCAAAGTGCTGGGCAACACCGATCGCCATTCAATCAAAAAGAACTTGATTGGTGCGCTGT

TGTTTGACTCCGGGGAAACCGCCGAGGCGACTCGCCTTAAACGTACAGCACGTCGCCGGTACACTCGGCGTAAGAAT

CGCATTTGCTATTTGCAGGAAATCTTTAGCAACGAGATGGCAAAAGTCGATGACTCGTTTTTCCACCGCCTCGAGGA

AAGCTTTCTGGTGGAGGAAGACAAAAAGCATGAGCGTCACCCGATCTTCGGCAACATTGTCGATGAAGTAGCGTATC

ATGAAAAATACCCAACCATTTACCACTTACGCAAAAAGCTGGTGGACAGCACTGACAAAGCTGATTTGCGCCTTATC

TATTTAGCCCTGGCACATATGATTAAGTTTCGTGGTCACTTCCTGATCGAAGGAGACTTAAATCCCGACAACAGTGA

TGTTGATAAATTGTTTATTCAGCTTGTCCAAACTTACAATCAACTGTTCGAGGAAAACCCGATCAATGCCTCCGGTG

TGGATGCAAAAGCCATTTTAAGTGCACGCCTTAGCAAGTCCCGTCGCTTAGAAAACCTTATCGCGCAGCTGCCCGGC

GAGAAAAAGAATGGTTTGTTTGGGAACCTTATTGCCTTGAGCTTAGGCCTCACCCCGAATTTCAAAAGTAATTTCGA

TCTTGCAGAAGACGCCAAATTACAACTGTCGAAGGATACTTATGATGACGATCTCGATAATCTGTTAGCGCAGATTG

GTGACCAATACGCCGATCTTTTTCTGGCGGCTAAAAATCTGAGCGACGCCATCTTGCTTTCGGATATTCTCCGCGTT

AACACCGAAATCACGAAAGCGCCTCTTAGTGCCAGCATGATTAAACGTTATGATGAACACCACCAGGACCTGACCTT

ACTCAAAGCGTTGGTTCGCCAGCAACTGCCAGAGAAGTACAAAGAAATCTTCTTTGATCAGTCAAAGAATGGTTATG

CCGGCTATATTGACGGGGGTGCAAGCCAAGAGGAATTCTACAAATTTATCAAGCCTATTCTGGAGAAAATGGATGGC

-continued

```
ACCGAAGAGTTATTGGTGAAGCTTAACCGTGAAGACCTCCTGCGGAAACAGCGCACATTCGATAATGGTTCGATCCC
ACACCAAATCCATTTGGGGGAGTTACACGCTATTTTGCGTCGCCAGGAAGACTTTTACCCTTTCCTGAAGGATAACC
GGGAGAAAATTGAGAAGATCCTTACCTTTCGTATTCCGTATTACGTAGGCCCCTTAGCACGGGGTAATAGCCGTTTC
GCGTGGATGACACGGAAGTCGGAAGAGACGATCACCCCGTGGAACTTCGAAGAGGTAGTCGACAAGGGCGCATCAGC
GCAGTCTTTTATTGAACGTATGACGAATTTCGATAAAAACTTGCCCAATGAGAAGGTGCTTCCGAAACATTCCTTGT
TATATGAATATTTTACAGTTTACAACGAGCTGACCAAGGTTAAATACGTGACGGAAGGAATGCGCAAGCCCGCTTTT
CTTAGCGGTGAGCAAAAAAGGCGATCGTCGACCTGTTATTCAAAACGAATCGTAAGGTGACTGTAAAGCAACTCAA
AGAAGATTACTTCAAAAAGATTGAGTGCTTCGACAGCGTCGAAATCTCTGGGGTAGAGGATCGGTTTAACGCAAGTT
TAGGTACCTACCATGACCTGCTTAAAATCATTAAGGATAAAGACTTCTTAGATAATGAAGAGAACGAAGATATTCTC
GAGGACATCGTCTTGACGTTAACCTTATTTGAGGATCGTGAAATGATTGAGGAACGCCTCAAAACTTATGCCCACCT
GTTCGACGATAAGGTGATGAAGCAGCTGAAACGTCGGCGCTACACAGGATGGGGCCGCTTGAGTCGCAAACTTATTA
ACGGAATCCGTGACAAGCAATCCGGCAAAACGATTCTGGATTTCTTGAAGTCGGACGGATTTGCTAATCGCAACTTC
ATGCAGTTGATCCATGATGACTCCCTGACTTTTAAAGAGGATATTCAAAAGGCGCAGGTTAGTGGTCAAGGCGACAG
CTTACACGAACACATCGCAAATTTGGCTGGTTCGCCGGCCATTAAAAAGGGGATCCTCCAGACCGTGAAAGTTGTAG
ATGAGCTTGTTAAGGTCATGGGTCGTCATAAGCCCGAAAACATCGTGATTGAAATGGCGCGGGAGAATCAAACGACC
CAGAAAGGACAAAAGAATAGCCGTGAACGGATGAAGCGGATCGAGGAAGGCATTAAAGAGCTGGGGTCTCAAATCTT
GAAGGAACACCCTGTGGAGAACACTCAGCTCCAAAATGAAAAACTTTACCTGTACTATTTGCAGAACGGACGCGATA
TGTACGTGGACCAAGAGTTGGATATTAATCGGCTGAGTGACTACGACGTTGATCATATCGTCCCGCAGAGCTTCCTC
AAAGACGATTCTATTGACAATAAGGTACTGACGCGCTCTGATAAAAACCGTGGTAAGTCGGACAACGTGCCCTCCGA
AGAGGTTGTGAAAAAGATGAAAAATTATTGGCGCCAGCTTTTAAACGCGAAGCTGATCACACAACGTAAATTCGATA
ATTTGACCAAGGCTGAACGGGGTGGCCTGAGCGAGTTAGATAAGGCAGGATTTATTAAACGCCAGTTAGTGGAGACT
CGTCAAATCACCAAACATGTCGCGCAGATTTTGGACAGCCGGATGAACACCAAGTACGATGAAAATGACAAACTGAT
CCGTGAGGTGAAAGTCATTACTCTGAAGTCCAAATTAGTTAGTGATTTCCGGAAGGACTTTCAATTCTACAAAGTCC
GTGAAATTAATAACTATCATCACGCACATGACGCGTACCTGAATGCAGTGGTTGGGACCGCCCTTATCAAGAAATAT
CCTAAGCTGGAGTCGGAGTTTGTCTATGGCGACTATAAGGTATACGATGTTCGCAAAATGATTGCGAAATCTGAGCA
GGAGATCGGTAAGGCAACCGCAAAATATTTCTTTTACTCAAACATTATGAATTTCTTTAAGACAGAAATCACTCTGG
CCAACGGGGAGATTCGCAAACGTCCGTTGATCGAAACAAACGGCGAGACTGGCGAAATTGTTTGGGACAAAGGGCGT
GATTTCGCGACGGTGCGCAAGGTACTGAGCATGCCTCAAGTCAATATTGTTAAGAAAACCGAAGTGCAGACGGGCGG
GTTTTCCAAGGAAAGCATCTTACCCAAACGTAATTCAGATAAACTTATTGCACGCAAAAAGGACTGGGATCCGAAAA
AGTATGGAGGCTTCGACAGTCCAACCGTAGCCTACTCTGTTCTCGTTGTAGCGAAAGTAGAAAAGGGTAAATCCAAG
AAACTGAAATCTGTCAAGGAGTTGCTTGGAATCACCATTATGGAGCGTAGCTCCTTCGAGAAGAACCCGATTGACTT
TCTGGAAGCCAAAGGATATAAAGAGGTCAAGAAAGATCTTATCATTAAGCTGCCTAAGTATTCACTCTTCGAGCTGG
AAAATGGTCGTAAACGCATGCTCGCTTCTGCCGGCGAGTTGCAGAAGGGCAATGAATTAGCACTTCCATCAAAGTAC
GTTAACTTCCTGTATTTGGCCAGCCATTACGAGAAACTGAAGGGGTCTCCAGAGGACAACGAACAGAAACAATTATT
TGTAGAGCAGCACAAGCATTATCTTGATGAAATCATTGAGCAAATTTCCGAATTCAGTAAACGCGTAATCCTGGCCG
ATGCAAACCTCGACAAGGTGCTGAGCGCTTACAATAAGCATCGCGACAAACCTATCCGTGAGCAGGCTGAAAATATC
ATTCACCTGTTCACATTAACGAACCTGGGCGCTCCGCCGCTTTTAAATATTTCGACACGACAATCGACCGTAAGCG
CTATACCAGTACGAAAGAAGTGTTGGATGCGACCCTTATTCACCAGTCAATTACAGGATTATATGAGACCCGTATCG
ACCTTAGCCAATTAGGTGGGGATGCGCCAGCGCCTGCTCCTGCACCCGCTCCAGCTCCTGCCCCAGCTCCAGCGCCC
GCTCCTGCACCTGCGATGGTGAGCAAAGGTGAAGAGGATAATATGGCCATCATCAAAGAATTCATGCGCTTCAAAGT
```

```
TCATATGGAAGGTAGCGTTAATGGCCACGAATTTGAAATTGAAGGTGAAGGCGAAGGTCGTCCGTATGAAGGCACCC
AGACCGCAAAACTGAAAGTTACCAAAGGTGGTCCGCTGCCGTTTGCATGGGATATTCTGAGTCCGCAGTTTATGTAT
GGTAGCAAAGCCTATGTTAAACATCCGGCAGATATCCCGGATTATCTGAAACTGAGCTTTCCGGAAGGTTTTAAATG
GGAACGTGTGATGAATTTTGAAGATGGTGGTGTTGTTACCGTTACACAGGATAGCAGCCTGCAGGATGGTGAATTTA
TCTATAAAGTTAAACTGCGTGGCACGAATTTTCCGAGTGATGGTCCGGTTATGCAGAAAAAAACCATGGGTTGGGAA
GCAAGCAGCGAACGTATGTATCCGGAAGATGGCGCACTGAAAGGTGAAATTAAACAGCGTCTGAAGCTGAAAGATGG
CGGTCATTATGATGCAGAAGTTAAAACCACCTACAAAGCCAAAAAACCGGTTCAGCTGCCTGGTGCATATAACGTTA
ACATTAAACTGGATATCACCAGCCACAACGAGGATTATACCATTGTTGAACAGTATGAACGTGCAGAAGGTCGCCAT
AGTACCGGTGGTATGGATGAACTGTATAAA
(Cas9-APAPAPAPAPAPAPAPAPAPAPAPA-mCherry chimera DNA sequence)
                                                                SEQ ID NO: 385
ATGGACAAAAAGTACTCTATTGGCCTGGATATCGGGACCAACAGCGTCGGGTGGGCTGTTATCACCGACGAGTATAA
AGTACCTTCGAAAAAGTTCAAAGTGCTGGGCAACACCGATCGCCATTCAATCAAAAAGAACTTGATTGGTGCGCTGT
TGTTTGACTCCGGGGAAACCGCCGAGGCGACTCGCCTTAAACGTACAGCACGTCGCCGGTACACTCGGCGTAAGAAT
CGCATTTGCTATTTGCAGGAAATCTTTAGCAACGAGATGGCAAAAGTCGATGACTCGTTTTTCCACCGCCTCGAGGA
AAGCTTTCTGGTGGAGGAAGACAAAAAGCATGAGCGTCACCCGATCTTCGGCAACATTGTCGATGAAGTAGCGTATC
ATGAAAAATACCCAACCATTTACCACTTACGCAAAAAGCTGGTGGACAGCACTGACAAAGCTGATTTGCGCCTTATC
TATTTAGCCCTGGCACATATGATTAAGTTTCGTGGTCACTTCCTGATCGAAGGAGACTTAAATCCCGACAACAGTGA
TGTTGATAAATTGTTTATTCAGCTTGTCCAAACTTACAATCAACTGTTCGAGGAAAACCCGATCAATGCCTCCGGTG
TGGATGCAAAAGCCATTTTAAGTGCACGCCTTAGCAAGTCCCGTCGCTTAGAAAACCTTATCGCGCAGCTGCCCGGC
GAGAAAAAGAATGGTTTGTTTGGGAACCTTATTGCCTTGAGCTTAGGCCTCACCCCGAATTTCAAAAGTAATTTCGA
TCTTGCAGAAGACGCCAAATTACAACTGTCGAAGGATACTTATGATGACGATCTCGATAATCTGTTAGCGCAGATTG
GTGACCAATACGCCGATCTTTTTCTGGCGGCTAAAAATCTGAGCGACGCCATCTTGCTTTCGGATATTCTCCGCGTT
AACACCGAAATCACGAAAGCGCCTCTTAGTGCCAGCATGATTAAACGTTATGATGAACACCACCAGGACCTGACCTT
ACTCAAAGCGTTGGTTCGCCAGCAACTGCCAGAGAAGTACAAAGAAATCTTCTTTGATCAGTCAAAGAATGGTTATG
CCGGCTATATTGACGGGGGTGCAAGCCAAGAGGAATTCTACAAATTTATCAAGCCTATTCTGGAGAAAATGGATGGC
ACCGAAGAGTTATTGGTGAAGCTTAACCGTGAAGACCTCCTGCGGAAACAGCGCACATTCGATAATGGTTCGATCCC
ACACCAAATCCATTTGGGGGAGTTACACGCTATTTTGCGTCGCCAGGAAGACTTTTACCCTTTCCTGAAGGATAACC
GGGAGAAAATTGAGAAGATCCTTACCTTTCGTATTCCGTATTACGTAGGCCCCTTAGCACGGGGTAATAGCCGTTTC
GCGTGGATGACACGGAAGTCGGAAGAGACGATCACCCCGTGGAACTTCGAAGAGGTAGTCGACAAGGGCGCATCAGC
GCAGTCTTTTATTGAACGTATGACGAATTTCGATAAAAACTTGCCCAATGAGAAGGTGCTTCCGAAACATTCCTTGT
TATATGAATATTTTACAGTTTACAACGAGCTGACCAAGGTTAAATACGTGACGGAAGGAATGCGCAAGCCCGCTTTT
CTTAGCGGTGAGCAAAAAAAGGCGATCGTCGACCTGTTATTCAAAACGAATCGTAAGGTGACTGTAAAGCAACTCAA
AGAAGATTACTTCAAAAAGATTGAGTGCTTCGACAGCGTCGAAATCTCTGGGGTAGAGGATCGGTTTAACGCAAGTT
TAGGTACCTACCATGACCTGCTTAAAATCATTAAGGATAAAGACTTCTTAGATAATGAAGAGAACGAAGATATTCTC
GAGGACATCGTCTTGACGTTAACCTTATTTGAGGATCGTGAAATGATTGAGGAACGCCTCAAAACTTATGCCCACCT
GTTCGACGATAAGGTGATGAAGCAGCTGAAACGTCGGCGCTACACAGGATGGGGCCGCTTGAGTCGCAAACTTATTA
ACGGAATCCGTGACAAGCAATCCGGCAAAACGATTCTGGATTTCTTGAAGTCGGACGGATTTGCTAATCGCAACTTC
ATGCAGTTGATCCATGATGACTCCCTGACTTTTAAAGAGGATATTCAAAAGGCGCAGGTTAGTGGTCAAGGCGACAG
CTTACACGAACACATCGCAAATTTGGCTGGTTCGCCGGCCATTAAAAAGGGGATCCTCCAGACCGTGAAAGTTGTAG
ATGAGCTTGTTAAGGTCATGGGTCGTCATAAGCCCGAAAACATCGTGATTGAAATGGCGCGGGAGAATCAAACGACC
CAGAAAGGACAAAAGAATAGCCGTGAACGGATGAAGCGGATCGAGGAAGGCATTAAAGAGCTGGGGTCTCAAATCTT
```

-continued

```
GAAGGAACACCCTGTGGAGAACACTCAGCTCCAAAATGAAAAACTTTACCTGTACTATTTGCAGAACGGACGCGATA
TGTACGTGGACCAAGAGTTGGATATTAATCGGCTGAGTGACTACGACGTTGATCATATCGTCCCGCAGAGCTTCCTC
AAAGACGATTCTATTGACAATAAGGTACTGACGCGCTCTGATAAAAACCGTGGTAAGTCGGACAACGTGCCCTCCGA
AGAGGTTGTGAAAAAGATGAAAAATTATTGGCGCCAGCTTTTAAACGCGAAGCTGATCACACAACGTAAATTCGATA
ATTTGACCAAGGCTGAACGGGGTGGCCTGAGCGAGTTAGATAAGGCAGGATTTATTAAACGCCAGTTAGTGGAGACT
CGTCAAATCACCAAACATGTCGCGCAGATTTTGGACAGCCGGATGAACACCAAGTACGATGAAAATGACAAACTGAT
CCGTGAGGTGAAAGTCATTACTCTGAAGTCCAAATTAGTTAGTGATTTCCGGAAGGACTTTCAATTCTACAAAGTCC
GTGAAATTAATAACTATCATCACGCACATGACGCGTACCTGAATGCAGTGGTTGGGACCGCCCTTATCAAGAAATAT
CCTAAGCTGGAGTCGGAGTTTGTCTATGGCGACTATAAGGTATACGATGTTCGCAAAATGATTGCGAAATCTGAGCA
GGAGATCGGTAAGGCAACCGCAAAATATTTCTTTTACTCAAACATTATGAATTTCTTTAAGACAGAAATCACTCTGG
CCAACGGGGAGATTCGCAAACGTCCGTTGATCGAAACAAACGGCGAGACTGGCGAAATTGTTTGGGACAAAGGGCGT
GATTTCGCGACGGTGCGCAAGGTACTGAGCATGCCTCAAGTCAATATTGTTAAGAAAACCGAAGTGCAGACGGGCGG
GTTTTCCAAGGAAAGCATCTTACCCAAACGTAATTCAGATAAACTTATTGCACGCAAAAAGGACTGGGATCCGAAAA
AGTATGGAGGCTTCGACAGTCCAACCGTAGCCTACTCTGTTCTCGTTGTAGCGAAAGTAGAAAAGGGTAAATCCAAG
AAACTGAAATCTGTCAAGGAGTTGCTTGGAATCACCATTATGGAGCGTAGCTCCTTCGAGAAGAACCCGATTGACTT
TCTGGAAGCCAAAGGATATAAAGAGGTCAAGAAAGATCTTATCATTAAGCTGCCTAAGTATTCACTCTTCGAGCTGG
AAAATGGTCGTAAACGCATGCTCGCTTCTGCCGGCGAGTTGCAGAAGGGCAATGAATTAGCACTTCCATCAAAGTAC
GTTAACTTCCTGTATTTGGCCAGCCATTACGAGAAACTGAAGGGGTCTCCAGAGGACAACGAACAGAAACAATTATT
TGTAGAGCAGCACAAGCATTATCTTGATGAAATCATTGAGCAAATTTCCGAATTCAGTAAACGCGTAATCCTGGCCG
ATGCAAACCTCGACAAGGTGCTGAGCGCTTACAATAAGCATCGCGACAAACCTATCCGTGAGCAGGCTGAAAATATC
ATTCACCTGTTCACATTAACGAACCTGGGCGCTCCGGCCGCTTTTAAATATTTCGACACGACAATCGACCGTAAGCG
CTATACCAGTACGAAAGAAGTGTTGGATGCGACCCTTATTCACCAGTCAATTACAGGATTATATGAGACCCGTATCG
ACCTTAGCCAATTAGGTGGGGATGCGCCAGCGCCTGCTCCTGCACCCGCTCCAGCTCCTGCCCCAGCTCCAGCGCCC
GCTCCTGCTCCTGCACCTGCGATGGTGAGCAAAGGTGAAGAGGATAATATGGCCATCATCAAAGAATTCATGCGCTT
CAAAGTTCATATGGAAGGTAGCGTTAATGGCCACGAATTTGAAATTGAAGGTGAAGGCGAAGGTCGTCCGTATGAAG
GCACCCAGACCGCAAAACTGAAAGTTACCAAAGGTGGTCCGCTGCCGTTTGCATGGGATATTCTGAGTCCGCAGTTT
ATGTATGGTAGCAAAGCCTATGTTAAACATCCGGCAGATATCCCGGATTATCTGAAACTGAGCTTTCCGGAAGGTTT
TAAATGGGAACGTGTGATGAATTTTGAAGATGGTGGTGTTGTTACCGTTACACAGGATAGCAGCCTGCAGGATGGTG
AATTTATCTATAAAGTTAAACTGCGTGGCACGAATTTTCCGAGTGATGGTCCGGTTATGCAGAAAAAAACCATGGGT
TGGGAAGCAAGCAGCGAACGTATGTATCCGGAAGATGGCGCACTGAAAGGTGAAATTAAACAGCGTCTGAAGCTGAA
AGATGGCGGTCATTATGATGCAGAAGTTAAAACCACCTACAAAGCCAAAAAACCGGTTCAGCTGCCTGGTGCATATA
ACGTTAACATTAAACTGGATATCACCAGCCACAACGAGGATTATACCATTGTTGAACAGTATGAACGTGCAGAAGGT
CGCCATAGTACCGGTGGTATGGATGAACTGTATAAA
```

(Cas9-APAPAPAPAPAPAPAPAPAPAPAPAPAPAPAPA-mCherry chimera DNA sequence)

SEQ ID NO: 386

```
ATGGACAAAAAGTACTCTATTGGCCTGGATATCGGGACCAACAGCGTCGGGTGGGCTGTTATCACCGACGAGTATAA
AGTACCTTCGAAAAAGTTCAAAGTGCTGGGCAACACCGATCGCCATTCAATCAAAAAGAACTTGATTGGTGCGCTGT
TGTTTGACTCCGGGGAAACCGCCGAGGCGACTCGCCTTAAACGTACAGCACGTCGCCGGTACACTCGGCGTAAGAAT
CGCATTTGCTATTTGCAGGAAATCTTTAGCAACGAGATGGCAAAAGTCGATGACTCGTTTTTCCACCGCCTCGAGGA
AAGCTTTCTGGTGGAGGAAGACAAAAAGCATGAGCGTCACCCGATCTTCGGCAACATTGTCGATGAAGTAGCGTATC
ATGAAAAATACCCAACCATTTACCACTTACGCAAAAAGCTGGTGGACAGCACTGACAAAGCTGATTTGCGCCTTATC
```

-continued

```
TATTTAGCCCTGGCACATATGATTAAGTTTCGTGGTCACTTCCTGATCGAAGGAGACTTAAATCCCGACAACAGTGA
TGTTGATAAATTGTTTATTCAGCTTGTCCAAACTTACAATCAACTGTTCGAGGAAAACCCGATCAATGCCTCCGGTG
TGGATGCAAAAGCCATTTTAAGTGCACGCCTTAGCAAGTCCCGTCGCTTAGAAAACCTTATCGCGCAGCTGCCCGGC
GAGAAAAAGAATGGTTTGTTTGGGAACCTTATTGCCTTGAGCTTAGGCCTCACCCCGAATTTCAAAAGTAATTTCGA
TCTTGCAGAAGACGCCAAATTACAACTGTCGAAGGATACTTATGATGACGATCTCGATAATCTGTTAGCGCAGATTG
GTGACCAATACGCCGATCTTTTTCTGGCGGCTAAAAATCTGAGCGACGCCATCTTGCTTTCGGATATTCTCCGCGTT
AACACCGAAATCACGAAAGCGCCTCTTAGTGCCAGCATGATTAAACGTTATGATGAACACCACCAGGACCTGACCTT
ACTCAAAGCGTTGGTTCGCCAGCAACTGCCAGAGAAGTACAAAGAAATCTTCTTTGATCAGTCAAAGAATGGTTATG
CCGGCTATATTGACGGGGGTGCAAGCCAAGAGGAATTCTACAAATTTATCAAGCCTATTCTGGAGAAAATGGATGGC
ACCGAAGAGTTATTGGTGAAGCTTAACCGTGAAGACCTCCTGCGGAAACAGCGCACATTCGATAATGGTTCGATCCC
ACACCAAATCCATTTGGGGGAGTTACACGCTATTTTGCGTCGCCAGGAAGACTTTTACCCTTTCCTGAAGGATAACC
GGGAGAAAATTGAGAAGATCCTTACCTTTCGTATTCCGTATTACGTAGGCCCCTTAGCACGGGGTAATAGCCGTTTC
GCGTGGATGACACGGAAGTCGGAAGAGACGATCACCCCGTGGAACTTCGAAGAGGTAGTCGACAAGGGCGCATCAGC
GCAGTCTTTTATTGAACGTATGACGAATTTCGATAAAAACTTGCCCAATGAGAAGGTGCTTCCGAAACATTCCTTGT
TATATGAATATTTTACAGTTTACAACGAGCTGACCAAGGTTAAATACGTGACGGAAGGAATGCGCAAGCCCGCTTTT
CTTAGCGGTGAGCAAAAAAGGCGATCGTCGACCTGTTATTCAAAACGAATCGTAAGGTGACTGTAAAGCAACTCAA
AGAAGATTACTTCAAAAAGATTGAGTGCTTCGACAGCGTCGAAATCTCTGGGGTAGAGGATCGGTTTAACGCAAGTT
TAGGTACCTACCATGACCTGCTTAAAATCATTAAGGATAAAGACTTCTTAGATAATGAAGAGAACGAAGATATTCTC
GAGGACATCGTCTTGACGTTAACCTTATTTGAGGATCGTGAAATGATTGAGGAACGCCTCAAAACTTATGCCCACCT
GTTCGACGATAAGGTGATGAAGCAGCTGAAACGTCGGCGCTACACAGGATGGGGCCGCTTGAGTCGCAAACTTATTA
ACGGAATCCGTGACAAGCAATCCGGCAAAACGATTCTGGATTTCTTGAAGTCGGACGGATTTGCTAATCGCAACTTC
ATGCAGTTGATCCATGATGACTCCCTGACTTTTAAAGAGGATATTCAAAAGGCGCAGGTTAGTGGTCAAGGCGACAG
CTTACACGAACACATCGCAAATTTGGCTGGTTCGCCGGCCATTAAAAAGGGGATCCTCCAGACCGTGAAAGTTGTAG
ATGAGCTTGTTAAGGTCATGGGTCGTCATAAGCCCGAAAACATCGTGATTGAAATGGCGCGGGAGAATCAAACGACC
CAGAAAGGACAAAAGAATAGCCGTGAACGGATGAAGCGGATCGAGGAAGGCATTAAAGAGCTGGGGTCTCAAATCTT
GAAGGAACACCCTGTGGAGAACACTCAGCTCCAAAATGAAAAACTTTACCTGTACTATTTGCAGAACGGACGCGATA
TGTACGTGGACCAAGAGTTGGATATTAATCGGCTGAGTGACTACGACGTTGATCATATCGTCCCGCAGAGCTTCCTC
AAAGACGATTCTATTGACAATAAGGTACTGACGCGCTCTGATAAAAACCGTGGTAAGTCGGACAACGTGCCCTCCGA
AGAGGTTGTGAAAAAGATGAAAAATTATTGGCGCCAGCTTTTAAACGCGAAGCTGATCACACAACGTAAATTCGATA
ATTTGACCAAGGCTGAACGGGGTGGCCTGAGCGAGTTAGATAAGGCAGGATTTATTAAACGCCAGTTAGTGGAGACT
CGTCAAATCACCAAACATGTCGCGCAGATTTTGGACAGCCGGATGAACACCAAGTACGATGAAAATGACAAACTGAT
CCGTGAGGTGAAAGTCATTACTCTGAAGTCCAAATTAGTTAGTGATTTCCGGAAGGACTTTCAATTCTACAAAGTCC
GTGAAATTAATAACTATCATCACGCACATGACGCGTACCTGAATGCAGTGGTTGGGACCGCCCTTATCAAGAAATAT
CCTAAGCTGGAGTCGGAGTTTGTCTATGGCGACTATAAGGTATACGATGTTCGCAAAATGATTGCGAAATCTGAGCA
GGAGATCGGTAAGGCAACCGCAAAATATTTCTTTTACTCAAACATTATGAATTTCTTTAAGACAGAAATCACTCTGG
CCAACGGGGAGATTCGCAAACGTCCGTTGATCGAAACAAACGGCGAGACTGGCGAAATTGTTTGGGACAAAGGGCGT
GATTTCGCGACGGTGCGCAAGGTACTGAGCATGCCTCAAGTCAATATTGTTAAGAAAACCGAAGTGCAGACGGGCGG
GTTTTCCAAGGAAAGCATCTTACCCAAACGTAATTCAGATAAACTTATTGCACGCAAAAAGGACTGGGATCCGAAAA
AGTATGGAGGCTTCGACAGTCCAACCGTAGCCTACTCTGTTCTCGTTGTAGCGAAAGTAGAAAAGGGTAAATCCAAG
AAACTGAAATCTGTCAAGGAGTTGCTTGGAATCACCATTATGGAGCGTAGCTCCTTCGAAGAACCCGATTGACTT
TCTGGAAGCCAAAGGATATAAAGAGGTCAAGAAAGATCTTATCATTAAGCTGCCTAAGTATTCACTCTTCGAGCTGG
```

```
AAAATGGTCGTAAACGCATGCTCGCTTCTGCCGGCGAGTTGCAGAAGGGCAATGAATTAGCACTTCCATCAAAGTAC

GTTAACTTCCTGTATTTGGCCAGCCATTACGAGAAACTGAAGGGGTCTCCAGAGGACAACGAACAGAAACAATTATT

TGTAGAGCAGCACAAGCATTATCTTGATGAAATCATTGAGCAAATTTCCGAATTCAGTAAACGCGTAATCCTGGCCG

ATGCAAACCTCGACAAGGTGCTGAGCGCTTACAATAAGCATCGCGACAAACCTATCCGTGAGCAGGCTGAAAATATC

ATTCACCTGTTCACATTAACGAACCTGGGCGCTCCGGCCGCTTTTAAATATTTCGACACGACAATCGACCGTAAGCG

CTATACCAGTACGAAAGAAGTGTTGGATGCGACCCTTATTCACCAGTCAATTACAGGATTATATGAGACCCGTATCG

ACCTTAGCCAATTAGGTGGGGATGCGCCAGCGCCTGCTCCTGCACCCGCTCCAGCTCCTGCCCCAGCTCCAGCGCCC

GCTCCTGCGCCAGCTCCTGCACCTGCGATGGTGAGCAAAGGTGAAGAGGATAATATGGCCATCATCAAAGAATTCAT

GCGCTTCAAAGTTCATATGGAAGGTAGCGTTAATGGCCACGAATTTGAAATTGAAGGTGAAGGCGAAGGTCGTCCGT

ATGAAGGCACCCAGACCGCAAAACTGAAAGTTACCAAAGGTGGTCCGCTGCCGTTTGCATGGGATATTCTGAGTCCG

CAGTTTATGTATGGTAGCAAAGCCTATGTTAAACATCCGGCAGATATCCCGGATTATCTGAAACTGAGCTTTCCGGA

AGGTTTTAAATGGGAACGTGTGATGAATTTTGAAGATGGTGGTGTTGTTACCGTTACACAGGATAGCAGCCTGCAGG

ATGGTGAATTTATCTATAAAGTTAAACTGCGTGGCACGAATTTTCCGAGTGATGGTCCGGTTATGCAGAAAAAACC

ATGGGTTGGGAAGCAAGCAGCGAACGTATGTATCCGGAAGATGGCGCACTGAAAGGTGAAATTAAACAGCGTCTGAA

GCTGAAAGATGGCGGTCATTATGATGCAGAAGTTAAAACCACCTACAAAGCCAAAAAACCGGTTCAGCTGCCTGGTG

CATATAACGTTAACATTAAACTGGATATCACCAGCCACAACGAGGATTATACCATTGTTGAACAGTATGAACGTGCA

GAAGGTCGCCATAGTACCGGTGGTATGGATGAACTGTATAAA
```

(Cas9-APAPAPAPAPAPAPAPAPAPAPAPAPAPAPAPA-mCherry chimera DNA sequence)

SEQ ID NO: 387

```
ATGGACAAAAAGTACTCTATTGGCCTGGATATCGGGACCAACAGCGTCGGGTGGGCTGTTATCACCGACGAGTATAA

AGTACCTTCGAAAAAGTTCAAAGTGCTGGGCAACACCGATCGCCATTCAATCAAAAAGAACTTGATTGGTGCGCTGT

TGTTTGACTCCGGGGAAACCGCCGAGGCGACTCGCCTTAAACGTACAGCACGTCGCCGGTACACTCGGCGTAAGAAT

CGCATTTGCTATTTGCAGGAAATCTTTAGCAACGAGATGGCAAAAGTCGATGACTCGTTTTTCCACCGCCTCGAGGA

AAGCTTTCTGGTGGAGGAAGACAAAAAGCATGAGCGTCACCCGATCTTCGGCAACATTGTCGATGAAGTAGCGTATC

ATGAAAAATACCCAACCATTTACCACTTACGCAAAAAGCTGGTGGACAGCACTGACAAAGCTGATTTGCGCCTTATC

TATTTAGCCCTGGCACATATGATTAAGTTTCGTGGTCACTTCCTGATCGAAGGAGACTTAAATCCCGACAACAGTGA

TGTTGATAAATTGTTTATTCAGCTTGTCCAAACTTACAATCAACTGTTCGAGGAAAACCCGATCAATGCCTCCGGTG

TGGATGCAAAAGCCATTTTAAGTGCACGCCTTAGCAAGTCCCGTCGCTTAGAAAACCTTATCGCGCAGCTGCCCGGC

GAGAAAAAGAATGGTTTGTTTGGGAACCTTATTGCCTTGAGCTTAGGCCTCACCCCGAATTTCAAAAGTAATTTCGA

TCTTGCAGAAGACGCCAAATTACAACTGTCGAAGGATACTTATGATGACGATCTCGATAATCTGTTAGCGCAGATTG

GTGACCAATACGCCGATCTTTTTCTGGCGGCTAAAAATCTGAGCGACGCCATCTTGCTTTCGGATATTCTCCGCGTT

AACACCGAAATCACGAAAGCGCCTCTTAGTGCCAGCATGATTAAACGTTATGATGAACACCACCAGGACCTGACCTT

ACTCAAAGCGTTGGTTCGCCAGCAACTGCCAGAGAAGTACAAAGAAATCTTCTTTGATCAGTCAAAGAATGGTTATG

CCGGCTATATTGACGGGGGTGCAAGCCAAGAGGAATTCTACAAATTTATCAAGCCTATTCTGGAGAAAATGGATGGC

ACCGAAGAGTTATTGGTGAAGCTTAACCGTGAAGACCTCCTGCGGAAACAGCGCACATTCGATAATGGTTCGATCCC

ACACCAAATCCATTTGGGGGAGTTACACGCTATTTTGCGTCGCCAGGAAGACTTTTACCCTTTCCTGAAGGATAACC

GGGAGAAAATTGAGAAGATCCTTACCTTTCGTATTCCGTATTACGTAGGCCCCTTAGCACGGGGTAATAGCCGTTTC

GCGTGGATGACACGGAAGTCGGAAGAGACGATCACCCCGTGGAACTTCGAAGAGGTAGTCGACAAGGGCGCATCAGC

GCAGTCTTTTATTGAACGTATGACGAATTTCGATAAAAACTTGCCCAATGAGAAGGTGCTTCCGAAACATTCCTTGT

TATATGAATATTTTACAGTTTACAACGAGCTGACCAAGGTTAAATACGTGACGGAAGGAATGCGCAAGCCCGCTTTT

CTTAGCGGTGAGCAAAAAAAGGCGATCGTCGACCTGTTATTCAAAACGAATCGTAAGGTGACTGTAAAGCAACTCAA
```

-continued

AGAAGATTACTTCAAAAAGATTGAGTGCTTCGACAGCGTCGAAATCTCTGGGGTAGAGGATCGGTTTAACGCAAGTT

TAGGTACCTACCATGACCTGCTTAAAATCATTAAGGATAAAGACTTCTTAGATAATGAAGAGAACGAAGATATTCTC

GAGGACATCGTCTTGACGTTAACCTTATTTGAGGATCGTGAAATGATTGAGGAACGCCTCAAAACTTATGCCCACCT

GTTCGACGATAAGGTGATGAAGCAGCTGAAACGTCGGCGCTACACAGGATGGGGCCGCTTGAGTCGCAAACTTATTA

ACGGAATCCGTGACAAGCAATCCGGCAAAACGATTCTGGATTTCTTGAAGTCGGACGGATTTGCTAATCGCAACTTC

ATGCAGTTGATCCATGATGACTCCCTGACTTTTAAAGAGGATATTCAAAAGGCGCAGGTTAGTGGTCAAGGCGACAG

CTTACACGAACACATCGCAAATTTGGCTGGTTCGCCGGCCATTAAAAAGGGGATCCTCCAGACCGTGAAAGTTGTAG

ATGAGCTTGTTAAGGTCATGGGTCGTCATAAGCCCGAAAACATCGTGATTGAAATGGCGCGGGAGAATCAAACGACC

CAGAAAGGACAAAAGAATAGCCGTGAACGGATGAAGCGGATCGAGGAAGGCATTAAAGAGCTGGGGTCTCAAATCTT

GAAGGAACACCCTGTGGAGAACACTCAGCTCCAAAATGAAAAACTTTACCTGTACTATTTGCAGAACGGACGCGATA

TGTACGTGGACCAAGAGTTGGATATTAATCGGCTGAGTGACTACGACGTTGATCATATCGTCCCGCAGAGCTTCCTC

AAAGACGATTCTATTGACAATAAGGTACTGACGCGCTCTGATAAAAACCGTGGTAAGTCGGACAACGTGCCCTCCGA

AGAGGTTGTGAAAAAGATGAAAAATTATTGGCGCCAGCTTTTAAACGCGAAGCTGATCACACAACGTAAATTCGATA

ATTTGACCAAGGCTGAACGGGGTGGCCTGAGCGAGTTAGATAAGGCAGGATTTATTAAACGCCAGTTAGTGGAGACT

CGTCAAATCACCAAACATGTCGCGCAGATTTTGGACAGCCGGATGAACACCAAGTACGATGAAAATGACAAACTGAT

CCGTGAGGTGAAAGTCATTACTCTGAAGTCCAAATTAGTTAGTGATTTCCGGAAGGACTTTCAATTCTACAAAGTCC

GTGAAATTAATAACTATCATCACGCACATGACGCGTACCTGAATGCAGTGGTTGGGACCGCCCTTATCAAGAAATAT

CCTAAGCTGGAGTCGGAGTTTGTCTATGGCGACTATAAGGTATACGATGTTCGCAAAATGATTGCGAAATCTGAGCA

GGAGATCGGTAAGGCAACCGCAAAATATTTCTTTTACTCAAACATTATGAATTTCTTTAAGACAGAAATCACTCTGG

CCAACGGGAGATTCGCAAACGTCCGTTGATCGAAACAAACGGCGAGACTGGCGAAATTGTTTGGGACAAAGGGCGT

GATTTCGCGACGGTGCGCAAGGTACTGAGCATGCCTCAAGTCAATATTGTTAAGAAAACCGAAGTGCAGACGGGCGG

GTTTTCCAAGGAAAGCATCTTACCCAAACGTAATTCAGATAAACTTATTGCACGCAAAAAGGACTGGGATCCGAAAA

AGTATGGAGGCTTCGACAGTCCAACCGTAGCCTACTCTGTTCTCGTTGTAGCGAAAGTAGAAAAGGGTAAATCCAAG

AAACTGAAATCTGTCAAGGAGTTGCTTGGAATCACCATTATGGAGCGTAGCTCCTTCGAGAAGAACCCGATTGACTT

TCTGGAAGCCAAAGGATATAAAGAGGTCAAGAAAGATCTTATCATTAAGCTGCCTAAGTATTCACTCTTCGAGCTGG

AAAATGGTCGTAAACGCATGCTCGCTTCTGCCGGCGAGTTGCAGAAGGGCAATGAATTAGCACTTCCATCAAAGTAC

GTTAACTTCCTGTATTTGGCCAGCCATTACGAGAAACTGAAGGGGTCTCCAGAGGACAACGAACAGAAACAATTATT

TGTAGAGCAGCACAAGCATTATCTTGATGAAATCATTGAGCAAATTTCCGAATTCAGTAAACGCGTAATCCTGGCCG

ATGCAAACCTCGACAAGGTGCTGAGCGCTTACAATAAGCATCGCGACAAACCTATCCGTGAGCAGGCTGAAAATATC

ATTCACCTGTTCACATTAACGAACCTGGGCGCTCCGGCCGCTTTTAAATATTTCGACACGACAATCGACCGTAAGCG

CTATACCAGTACGAAAGAAGTGTTGGATGCGACCCTTATTCACCAGTCAATTACAGGATTATATGAGACCCGTATCG

ACCTTAGCCAATTAGGTGGGGATGCGCCAGCGCCTGCTCCTGCACCCGCTCCAGCTCCTGCCCCAGCTCCAGCGCCC

GCTCCTGCGCCAGCTCCTGCACCTGCTCCAGCGATGGTGAGCAAAGGTGAAGAGGATAATATGGCCATCATCAAAGA

ATTCATGCGCTTCAAAGTTCATATGGAAGGTAGCGTTAATGGCCACGAATTTGAAATTGAAGGTGAAGGCGAAGGTC

GTCCGTATGAAGGCACCCAGACCGCAAAACTGAAAGTTACCAAAGGTGGTCCGCTGCCGTTTGCATGGGATATTCTG

AGTCCGCAGTTTATGTATGGTAGCAAAGCCTATGTTAAACATCCGGCAGATATCCCGGATTATCTGAAACTGAGCTT

TCCGGAAGGTTTTAAATGGGAACGTGTGATGAATTTTGAAGATGGTGGTGTTGTTACCGTTACACAGGATAGCAGCC

TGCAGGATGGTGAATTTATCTATAAAGTTAAACTGCGTGGCACGAATTTTCCGAGTGATGGTCCGGTTATGCAGAAA

AAAACCATGGGTTGGGAAGCAAGCAGCGAACGTATGTATCCGGAAGATGGCGCACTGAAAGGTGAAATTAAACAGCG

-continued

```
TCTGAAGCTGAAAGATGGCGGTCATTATGATGCAGAAGTTAAAACCACCTACAAAGCCAAAAAACCGGTTCAGCTGC
CTGGTGCATATAACGTTAACATTAAACTGGATATCACCAGCCACAACGAGGATTATACCATTGTTGAACAGTATGAA
CGTGCAGAAGGTCGCCATAGTACCGGTGGTATGGATGAACTGTATAAA
```

Exemplary DNA sequences encoding LbCas12a (E795L) variant protein amino
acid chimeras
(LbCas12a (E795L)-eGFP chimera DNA sequence)

SEQ ID NO: 388

```
ATGAGCAAACTGGAAAAGTTCACCAACTGTTATAGCCTGAGCAAAACCCTGCGTTTTAAAGCAATTCCGGTTGGTAA
AACCCAAGAGAACATTGATAATAAACGCCTGCTGGTCGAAGATGAAAAACGCGCTGAAGATTATAAAGGCGTGAAAA
AACTGCTGGATCGCTATTATCTGAGCTTCATTAACGATGTGCTGCACAGCATTAAACTGAAGAACCTGAACAACTAT
ATCAGCCTGTTTCGTAAAAAAACCCGCACCGAAAAAGAAAACAAAGAGCTGGAAAACCTGGAAATCAATCTGCGTAA
AGAAATCGCCAAAGCGTTTAAAGGTAACGAGGGTTATAAAAGCCTGTTCAAGAAAGACATCATCGAAACCATTCTGC
CGGAATTTCTGGATGATAAAGATGAAATTGCCCTGGTGAATAGCTTTAATGGCTTTACCACCGCATTTACCGGCTTT
TTTGATAATCGCGAAAACATGTTCAGCGAAGAAGCAAAAAGCACCAGCATTGCATTTCGCTGCATTAATGAAATCT
GACCCGCTACATTAGCAACATGGATATCTTTGAAAAAGTGGACGCGATCTTCGATAAACACGAAGTGCAAGAGATCA
AAGAGAAATCCTGAACAGCGATTATGACGTCGAAGATTTTTTTGAAGGCGAGTTCTTTAACTTCGTTCTGACCCAA
GAAGGTATCGACGTTTATAACGCAATTATTGGTGGTTTTGTTACCGAAAGCGGTGAGAAAATCAAAGGCCTGAATGA
ATATATCAACCTGTATAACCAGAAAACCAAACAGAAACTGCCGAAATTCAAACCGCTGTATAAACAGGTTCTGAGCG
ATCGTGAAAGCCTGAGCTTTTATGGTGAAGGTTATACCAGTGATGAAGAGGTTCTGGAAGTTTTTCGTAACACCCTG
AATAAAAACAGCGAGATCTTTAGCAGCATCAAAAAGCTTGAGAAACTGTTCAAAAACTTTGATGAGTATAGCAGCGC
AGGCATCTTTGTTAAAAATGGTCCGGCAATTAGCACCATCAGCAAAGATATTTTTGGCGAATGGAATGTGATCCGCG
ATAAATGGAATGCCGAATATGATGATATCCACCTGAAAAAAAAGGCCGTGGTGACCGAGAAATATGAAGATGATCGT
CGTAAAAGCTTCAAGAAAATTGGTAGCTTTAGCCTGGAACAGCTGCAAGAATATGCAGATGCAGATCTGAGCGTTGT
GGAAAAACTGAAAGAAATCATCATTCAGAAGGTGGACGAGATCTATAAAGTTTATGGTAGCAGCGAAAAACTGTTCG
ATGCAGATTTTGTTCTGGAAAAAAGCCTGAAAAAGAATGATGCCGTTGTGGCCATTATGAAAGATCTGCTGGATAGC
GTTAAGAGCTTCGAGAATTACATCAAAGCCTTTTTTGGTGAGGGCAAAGAAACCAATCGTGATGAAAGTTTCTATGG
CGATTTTGTGCTGGCCTATGATATTCTGCTGAAAGTGGACCATATTTATGATGCCATTCGCAATTATGTTACCCAGA
AACCGTATAGCAAAGACAAGTTCAAACTGTACTTTCAGAACCCCGCAGTTTATGGGTGGTTGGGATAAAGATAAAGAA
ACCGATTATCGTGCCACCATCCTGCGTTATGGTAGTAAATACTATCTGGCCATCATGGACAAAAAATACGCAAAATG
CCTGCAGAAAATCGACAAAGATGATGTGAATGGCAACTATGAAAAAATCAACTACAAACTGCTGCCTGGTCCGAATA
AAATGCTGCCGAAAGTGTTCTTTAGCAAGAAATGGATGGCCTATTATAACCCGAGCGAGGATATTCAAAAGATCTAC
AAAAATGGCACCTTTAAAAAGGGCGACATGTTCAATCTGAACGATTGCCACAAACTGATCGATTTCTTCAAAGATTC
AATTTCGCGTTATCCGAAATGGTCCAATGCCTATGATTTTAACTTTAGCGAAACCGAAAAATACAAAGACATTGCCG
GTTTTTATCGCGAAGTGGAAGAACAGGGCTATAAAGTGAGCTTTGAAAGCGCAAGCAAAAAGAGGTTGATAAGCTG
GTTGAAGAGGGCAAACTGTATATGTTCCAGATTTACAACAAAGATTTTAGCGACAAAAGCCATGGCACCCCGAATCT
GCATACCATGTACTTTAAACTGCTGTTCGACGAAAATAACCATGGTCAGATTCGTCTGAGCGGTGGTGCCGAACTGT
TTATGCGTCGTGCAAGTCTGAAAAAAGAAGAACTGGTTGTTCATCCGGCAAATAGCCCCGATTGCAAACAAAAATCCG
GACAATCCGAAAAAAACCACGACACTGAGCTATGATGTGTATAAAGACAAACGTTTTAGCGAGGATCAGTATCTGCT
GCATATCCCGATTGCCATCAATAAATGCCCGAAAAACATCTTTAAGATCAACACCGAAGTTCGCGTGCTGCTGAAAC
ATGATGATAATCCGTATGTGATTGGCATTGATCGTGGTGAACGTAACCTGCTGTATATTGTTGTTGTTGATGGTAAA
GGCAACATCGTGGAACAGTATAGTCTGAACGAAATTATCAACAACTTTAACGGCATCCGCATCAAAACCGACTATCA
TAGCCTGCTGGACAAGAAAGAAAAAGAACGTTTTGAAGCACGTCAGAACTGGACCAGTATTGAAAACATCAAAGAAC
```

-continued

TGAAAGCCGGTTATATTAGCCAGGTGGTTCATAAAATCTGTGAGCTGGTAGAAAAATACGATGCAGTTATTGCACTG

GAAGATCTGAATAGCGGTTTCAAAAATAGCCGTGTGAAAGTCGAAAAACAGGTGTATCAGAAATTCGAGAAAATGCT

GATCGACAAACTGAACTACATGGTCGACAAAAAAAGCAATCCGTGTGCAACCGGTGGTGCACTGAAAGGTTATCAGA

TTACCAACAAATTTGAAAGCTTTAAAAGCATGAGCACCCAGAACGGCTTTATCTTCTATATTCCGGCATGGCTGACC

AGCAAAATTGATCCGAGCACCGGTTTTGTGAACCTGCTGAAAACAAAATATACCTCCATTGCCGACAGCAAGAAGTT

TATTAGCAGCTTTGATCGCATTATGTATGTTCCGGAAGAGGACCTGTTTGAATTCGCACTGGATTACAAAAATTTCA

GCCGTACCGATGCCGACTACATCAAAAAATGGAAACTGTACAGCTATGGTAACCGCATTCGCATTTTTCGCAACCCG

AAGAAAAACAATGTGTTCGATTGGGAAGAAGTTTGTCTGACCAGCGCATATAAAGAACTTTTCAACAAATACGGCAT

CAACTATCAGCAGGGTGATATTCGTGCACTGCTGTGTGAACAGAGCGATAAAGCGTTTTATAGCAGTTTTATGGCAC

TGATGAGCCTGATGCTGCAGATGCGTAATAGCATTACCGGTCGCACCGATGTGGATTTTCTGATTAGTCCGGTGAAA

AATTCCGATGGCATCTTTTATGATAGCCGCAATTACGAAGCACAAGAAAATGCAATTCTGCCGAAAAACGCAGATGC

AAATGGTGCATATAACATTGCACGTAAAGTTCTGTGGGCAATTGGCCAGTTTAAGAAAGCAGAAGATGAGAAGCTGG

ACAAAGTGAAAATTGCGATCAGCAATAAAGAGTGGCTGGAATACGCACAGACCAGCGTTAAACATATGGTTAGCAAA

GGTGAAGAACTGTTTACCGGCGTTGTGCCGATTCTGGTGGAACTGGATGGTGATGTGAATGGCCATAAATTTAGCGT

TAGCGGCGAAGGCGAAGGTGATGCGACCTATGGTAAACTGACCCTGAAATTTATTTGCACCACCGGTAAACTGCCGG

TTCCGTGGCCGACCCTGGTGACCACCCTGACCTATGGCGTTCAGTGCTTTAGCCGCTATCCGGATCATATGAAACAG

CATGATTTCTTTAAAAGCGCGATGCCGGAAGGCTATGTGCAGGAACGTACCATTTTTTTCAAAGATGATGGCAACTA

TAAAACCCGTGCGGAAGTTAAATTTGAAGGCGATACCCTGGTGAACCGCATTGAACTGAAAGGTATTGATTTTAAAG

AAGATGGCAACATTCTGGGTCATAAACTGGAATATAATTACAACAGCCATAATGTGTATATTATGGCCGATAAACAG

AAAAATGGCATCAAAGTGAACTTTAAAATCCGTCACAACATTGAAGATGGTAGCGTGCAGCTGGCGGATCATTATCA

GCAGAATACCCCGATTGGTGATGGCCCGGTGCTGCTGCCGGATAATCATTATCTGAGCACCCAGAGCGCGCTGAGCA

AAGATCCGAATGAAAACGTGATCATATGGTGCTGCTGGAATTTGTTACCGCCGCGGGCATTACCCTGGGTATGGAT

GAACTGTATAAA (LbCas12a (E795L)-GSAGSAAGSGEF-eGFP chimera DNA sequence)

SEQ ID NO: 389

ATGAGCAAACTGGAAAAGTTCACCAACTGTTATAGCCTGAGCAAAACCCTGCGTTTTAAAGCAATTCCGGTTGGTAA

AACCCAAGAGAACATTGATAATAAACGCCTGCTGGTCGAAGATGAAAAACGCGCTGAAGATTATAAAGGCGTGAAAA

AACTGCTGGATCGCTATTATCTGAGCTTCATTAACGATGTGCTGCACAGCATTAAACTGAAGAACCTGAACAACTAT

ATCAGCCTGTTTCGTAAAAAAACCCGCACCGAAAAAGAAAACAAAGAGCTGGAAAACCTGGAAATCAATCTGCGTAA

AGAAATCGCCAAAGCGTTTAAAGGTAACGAGGGTTATAAAAGCCTGTTCAAGAAAGACATCATCGAAACCATTCTGC

CGGAATTTCTGGATGATAAAGATGAAATTGCCCTGGTGAATAGCTTTAATGGCTTTACCACCGCATTTACCGGCTTT

TTTGATAATCGCGAAAACATGTTCAGCGAAGAAGCAAAAAGCACCAGCATTGCATTTCGCTGCATTAATGAAAATCT

GACCCGCTACATTAGCAACATGGATATCTTTGAAAAAGTGGACGCGATCTTCGATAAACACGAAGTGCAAGAGATCA

AAGAGAAAATCCTGAACAGCGATTATGACGTCGAAGATTTTTTTGAAGGCGAGTTCTTTAACTTCGTTCTGACCCAA

GAAGGTATCGACGTTTATAACGCAATTATTGGTGGTTTTGTTACCGAAAGCGGTGAGAAAATCAAAGGCCTGAATGA

ATATATCAACCTGTATAACCAGAAAACCAAACAGAAACTGCCGAAATTCAAACCGCTGTATAAACAGGTTCTGAGCG

ATCGTGAAAGCCTGAGCTTTTATGGTGAAGGTTATACCAGTGATGAAGAGGTTCTGGAAGTTTTTCGTAACACCCTG

AATAAAAACAGCGAGATCTTTAGCAGCATCAAAAAGCTTGAGAAACTGTTCAAAAACTTTGATGAGTATAGCAGCGC

AGGCATCTTTGTTAAAAATGGTCCGGCAATTAGCACCATCAGCAAAGATATTTTTGGCGAATGGAATGTGATCCGCG

ATAAATGGAATGCCGAATATGATGATATCCACCTGAAAAAAAAGGCCGTGGTGACCGAGAAATATGAAGATGATCGT

CGTAAAAGCTTCAAGAAAATTGGTAGCTTTAGCCTGGAACAGCTGCAAGAATATGCAGATGCAGATCTGAGCGTTGT

GGAAAAACTGAAAGAAATCATCATTCAGAAGGTGGACGAGATCTATAAAGTTTATGGTAGCAGCGAAAAACTGTTCG

-continued

```
ATGCAGATTTTGTTCTGGAAAAAAGCCTGAAAAGAATGATGCCGTTGTGGCCATTATGAAAGATCTGCTGGATAGC
GTTAAGAGCTTCGAGAATTACATCAAAGCCTTTTTTGGTGAGGGCAAAGAAACCAATCGTGATGAAAGTTTCTATGG
CGATTTTGTGCTGGCCTATGATATTCTGCTGAAAGTGGACCATATTTATGATGCCATTCGCAATTATGTTACCCAGA
AACCGTATAGCAAAGACAAGTTCAAACTGTACTTTCAGAACCCGCAGTTTATGGGTGGTTGGGATAAAGATAAAGAA
ACCGATTATCGTGCCACCATCCTGCGTTATGGTAGTAAATACTATCTGGCCATCATGGACAAAAAATACGCAAAATG
CCTGCAGAAAATCGACAAAGATGATGTGAATGGCAACTATGAAAAAATCAACTACAAACTGCTGCCTGGTCCGAATA
AAATGCTGCCGAAAGTGTTCTTTAGCAAGAAATGGATGGCCTATTATAACCCGAGCGAGGATATTCAAAAGATCTAC
AAAAATGGCACCTTTAAAAAGGGCGACATGTTCAATCTGAACGATTGCCACAAACTGATCGATTTCTTCAAAGATTC
AATTTCGCGTTATCCGAAATGGTCCAATGCCTATGATTTTAACTTTAGCGAAACCGAAAAATACAAAGACATTGCCG
GTTTTTATCGCGAAGTGGAAGAACAGGGCTATAAAGTGAGCTTTGAAAGCGCAAGCAAAAAGAGGTTGATAAGCTG
GTTGAAGAGGGCAAACTGTATATGTTCCAGATTTACAACAAAGATTTTAGCGACAAAAGCCATGGCACCCCGAATCT
GCATACCATGTACTTTAAACTGCTGTTCGACGAAAATAACCATGGTCAGATTCGTCTGAGCGGTGGTGCCGAACTGT
TTATGCGTCGTGCAAGTCTGAAAAAAGAAGAACTGGTTGTTCATCCGGCAAATAGCCCGATTGCAAACAAAAATCCG
GACAATCCGAAAAAAACCACGACACTGAGCTATGATGTGTATAAAGACAAACGTTTTAGCGAGGATCAGTATCTGCT
GCATATCCCGATTGCCATCAATAAATGCCCGAAAAACATCTTTAAGATCAACACCGAAGTTCGCGTGCTGCTGAAAC
ATGATGATAATCCGTATGTGATTGGCATTGATCGTGGTGAACGTAACCTGCTGTATATTGTTGTTGTTGATGGTAAA
GGCAACATCGTGGAACAGTATAGTCTGAACGAAATTATCAACAACTTTAACGGCATCCGCATCAAAACCGACTATCA
TAGCCTGCTGGACAAGAAAGAAAAAGAACGTTTTGAAGCACGTCAGAACTGGACCAGTATTGAAAACATCAAAGAAC
TGAAAGCCGGTTATATTAGCCAGGTGGTTCATAAAATCTGTGAGCTGGTAGAAAAATACGATGCAGTTATTGCACTG
GAAGATCTGAATAGCGGTTTCAAAAATAGCCGTGTGAAAGTCGAAAAACAGGTGTATCAGAAATTCGAGAAAATGCT
GATCGACAAACTGAACTACATGGTCGACAAAAAAAGCAATCCGTGTGCAACCGGTGGTGCACTGAAAGGTTATCAGA
TTACCAACAAATTTGAAAGCTTTAAAAGCATGAGCACCCAGAACGGCTTTATCTTCTATATTCCGGCATGGCTGACC
AGCAAAATTGATCCGAGCACCGGTTTTGTGAACCTGCTGAAAACAAAATATACCTCCATTGCCGACAGCAAGAAGTT
TATTAGCAGCTTTGATCGCATTATGTATGTTCCGGAAGAGGACCTGTTTGAATTCGCACTGGATTACAAAAATTTCA
GCCGTACCGATGCCGACTACATCAAAAAATGGAAACTGTACAGCTATGGTAACCGCATTCGCATTTTTCGCAACCCG
AAGAAAAACAATGTGTTCGATTGGGAAGAAGTTTGTCTGACCAGCGCATATAAAGAACTTTTCAACAAATACGGCAT
CAACTATCAGCAGGGTGATATTCGTGCACTGCTGTGTGAACAGAGCGATAAAGCGTTTTATAGCAGTTTTATGGCAC
TGATGAGCCTGATGCTGCAGATGCGTAATAGCATTACCGGTCGCACCGATGTGGATTTTCTGATTAGTCCGGTGAAA
AATTCCGATGGCATCTTTTATGATAGCCGCAATTACGAAGCACAAGAAATGCAATTCTGCCGAAAAACGCAGATGC
AAATGGTGCATATAACATTGCACGTAAAGTTCTGTGGGCAATTGGCCAGTTTAAGAAAGCAGAAGATGAGAAGCTGG
ACAAAGTGAAAATTGCGATCAGCAATAAAGAGTGGCTGGAATACGCACACGACCAGCGTTAAACATGGTAGCGCAGGT
AGTGCAGCAGGTAGCGGTGAATTTATGGTTAGCAAAGGTGAAGAACTGTTTACCGGCGTTGTGCCGATTCTGGTGGA
ACTGGATGGTGATGTGAATGGCCATAAATTTAGCGTTAGCGGCGAAGGCGAAGGTGATGCGACCTATGGTAAACTGA
CCCTGAAATTTATTTGCACCACCGGTAAACTGCCGGTTCCGTGGCCGACCCTGGTGACCACCCTGACCTATGGCGTT
CAGTGCTTTAGCCGCTATCCGGATCATATGAAACAGCATGATTTCTTTAAAAGCGCGATGCCGGAAGGCTATGTGCA
GGAACGTACCATTTTTTTCAAAGATGATGGCAACTATAAAACCCGTGCGGAAGTTAAATTTGAAGGCGATACCCTGG
TGAACCGCATTGAACTGAAAGGTATTGATTTTAAAGAAGATGGCAACATTCTGGGTCATAAACTGGAATATAATTAC
AACAGCCATAATGTGTATATTATGGCCGATAAACAGAAAAATGGCATCAAAGTGAACTTTAAAATCCGTCACAACAT
```

TGAAGATGGTAGCGTGCAGCTGGCGGATCATTATCAGCAGAATACCCCGATTGGTGATGGCCCGGTGCTGCTGCCGG

ATAATCATTATCTGAGCACCCAGAGCGCGCTGAGCAAAGATCCGAATGAAAAACGTGATCATATGGTGCTGCTGGAA

TTTGTTACCGCCGCGGGCATTACCCTGGGTATGGATGAACTGTATAAA (LbCas12a (E795L)-(GGGGS)₄-eGFP chimera DNA sequence)

SEQ ID NO: 390

ATGAGCAAACTGGAAAAGTTCACCAACTGTTATAGCCTGAGCAAAACCCTGCGTTTTAAAGCAATTCCGGTTGGTAA

AACCCAAGAGAACATTGATAATAAACGCCTGCTGGTCGAAGATGAAAAACGCGCTGAAGATTATAAAGGCGTGAAAA

AACTGCTGGATCGCTATTATCTGAGCTTCATTAACGATGTGCTGCACAGCATTAAACTGAAGAACCTGAACAACTAT

ATCAGCCTGTTTCGTAAAAAAACCCGCACCGAAAAGAAAACAAAGAGCTGGAAAACCTGGAAATCAATCTGCGTAA

AGAAATCGCCAAAGCGTTTAAAGGTAACGAGGGTTATAAAAGCCTGTTCAAGAAAGACATCATCGAAACCATTCTGC

CGGAATTTCTGGATGATAAAGATGAAATTGCCCTGGTGAATAGCTTTAATGGCTTTACCACCGCATTTACCGGCTTT

TTTGATAATCGCGAAAACATGTTCAGCGAAGAAGCAAAAAGCACCAGCATTGCATTTCGCTGCATTAATGAAAATCT

GACCCGCTACATTAGCAACATGGATATCTTTGAAAAAGTGGACGCGATCTTCGATAAACACGAAGTGCAAGAGATCA

AAGAGAAAATCCTGAACAGCGATTATGACGTCGAAGATTTTTTTGAAGGCGAGTTCTTTAACTTCGTTCTGACCCAA

GAAGGTATCGACGTTTATAACGCAATTATTGGTGGTTTTGTTACCGAAAGCGGTGAGAAAATCAAAGGCCTGAATGA

ATATATCAACCTGTATAACCAGAAAACCAAACAGAAACTGCCGAAATTCAAACCGCTGTATAAACAGGTTCTGAGCG

ATCGTGAAAGCCTGAGCTTTTATGGTGAAGGTTATACCAGTGATGAAGAGGTTCTGGAAGTTTTTCGTAACACCCTG

AATAAAAACAGCGAGATCTTTAGCAGCATCAAAAAGCTTGAGAAACTGTTCAAAAACTTTGATGAGTATAGCAGCGC

AGGCATCTTTGTTAAAAATGGTCCGGCAATTAGCACCATCAGCAAAGATATTTTTGGCAATGGAATGTGATCCGCG

ATAAATGGAATGCCGAATATGATGATATCCACCTGAAAAAAAGGCCGTGGTGACCGAGAAATATGAAGATGATCGT

CGTAAAAGCTTCAAGAAAATTGGTAGCTTTAGCCTGGAACAGCTGCAAGAATATGCAGATGCAGATCTGAGCGTTGT

GGAAAAAACTGAAAGAAATCATCATTCAGAAGGTGGACGAGATCTATAAAGTTTATGGTAGCAGCGAAAAACTGTTCG

ATGCAGATTTTGTTCTGGAAAAAAGCCTGAAAAAGAATGATGCCGTTGTGGCCATTATGAAAGATCTGCTGGATAGC

GTTAAGAGCTTCGAGAATTACATCAAAGCCTTTTTTGGTGAGGGCAAAGAAACCAATCGTGATGAAAGTTTCTATGG

CGATTTTGTGCTGGCCTATGATATTCTGCTGAAAGTGGACCATATTTATGATGCCATTCGCAATTATGTTACCCAGA

AACCGTATAGCAAAGACAAGTTCAAACTGTACTTTCAGAACCCGCAGTTTATGGGTGGTTGGGATAAAGATAAGAA

ACCGATTATCGTGCCACCATCCTGCGTTATGGTAGTAAATACTATCTGGCCATCATGGACAAAAAATACGCAAAATG

CCTGCAGAAAATCGACAAAGATGATGTGAATGGCAACTATGAAAAAATCAACTACAAACTGCTGCCTGGTCCGAATA

AAATGCTGCCGAAAGTGTTCTTTAGCAAGAAATGGATGGCCTATTATAACCCGAGCGAGGATATTCAAAGATCTAC

AAAAATGGCACCTTTAAAAAGGGCGACATGTTCAATCTGAACGATTGCCACAAACTGATCGATTTCTTCAAAGATTC

AATTTCGCGTTATCCGAAATGGTCCAATGCCTATGATTTTAACTTTAGCGAAACCGAAAAATACAAAGACATTGCCG

GTTTTTATCGCGAAGTGGAAGAACAGGGCTATAAAGTGAGCTTTGAAAGCGCAAGCAAAAAGAGGTTGATAAGCTG

GTTGAAGAGGGCAAACTGTATATGTTCCAGATTTACAACAAAGATTTTAGCGACAAAAGCCATGGCACCCCGAATCT

GCATACCATGTACTTTAAACTGCTGTTCGACGAAAATAACCATGGTCAGATTCGTCTGAGCGGTGGTGCCGAACTGT

TTATGCGTCGTGCAAGTCTGAAAAAAGAAGAACTGGTTGTTCATCCGGCAAATAGCCCGATTGCAAACAAAAATCCG

GACAATCCGAAAAAAACCACGACACTGAGCTATGATGTGTATAAAGACAAACGTTTTAGCGAGGATCAGTATCTGCT

GCATATCCCGATTGCCATCAATAAATGCCCGAAAAACATCTTTAAGATCAACACCGAAGTTCGCGTGCTGCTGAAAC

ATGATGATAATCCGTATGTGATTGGCATTGATCGTGGTGAACGTAACCTGCTGTATATTGTTGTTGTTGATGGTAAA

GGCAACATCGTGGAACAGTATAGTCTGAACGAAATTATCAACAACTTTAACGGCATCCGCATCAAAACCGACTATCA

TAGCCTGCTGGACAAGAAAGAAAAAGAACGTTTTGAAGCACGTCAGAACTGGACCAGTATTGAAAACATCAAAGAAC

TGAAAGCCGGTTATATTAGCCAGGTGGTTCATAAAATCTGTGAGCTGGTAGAAAAATACGATGCAGTTATTGCACTG

-continued

```
GAAGATCTGAATAGCGGTTTCAAAAATAGCCGTGTGAAAGTCGAAAAACAGGTGTATCAGAAATTCGAGAAAATGCT

GATCGACAAACTGAACTACATGGTCGACAAAAAAAGCAATCCGTGTGCAACCGGTGGTGCACTGAAAGGTTATCAGA

TTACCAACAAATTTGAAAGCTTTAAAAGCATGAGCACCCAGAACGGCTTTATCTTCTATATTCCGGCATGGCTGACC

AGCAAAATTGATCCGAGCACCGGTTTTGTGAACCTGCTGAAAACAAAATATACCTCCATTGCCGACAGCAAGAAGTT

TATTAGCAGCTTTGATCGCATTATGTATGTTCCGGAAGAGGACCTGTTTGAATTCGCACTGGATTACAAAAATTTCA

GCCGTACCGATGCCGACTACATCAAAAAATGGAAACTGTACAGCTATGGTAACCGCATTCGCATTTTTCGCAACCCG

AAGAAAAACAATGTGTTCGATTGGGAAGAAGTTTGTCTGACCAGCGCATATAAAGAACTTTTCAACAAATACGGCAT

CAACTATCAGCAGGGTGATATTCGTGCACTGCTGTGTGAACAGAGCGATAAAGCGTTTTATAGCAGTTTTATGGCAC

TGATGAGCCTGATGCTGCAGATGCGTAATAGCATTACCGGTCGCACCGATGTGGATTTTCTGATTAGTCCGGTGAAA

AATTCCGATGGCATCTTTTATGATAGCCGCAATTACGAAGCACAAGAAAATGCAATTCTGCCGAAAAACGCAGATGC

AAATGGTGCATATAACATTGCACGTAAAGTTCTGTGGGCAATTGGCCAGTTTAAGAAAGCAGAAGATGAGAAGCTGG

ACAAAGTGAAAATTGCGATCAGCAATAAAGAGTGGCTGGAATACGCACAGACCAGCGTTAAACATGGAGGCGGAGGA

TCAGGCGGTGGCGGAAGTGGTGGAGGTGGGTCGGGAGGTGGTGGTAGCATGGTTAGCAAAGGTGAAGAACTGTTTAC

CGGCGTTGTGCCGATTCTGGTGGAACTGGATGGTGATGTGAATGGCCATAAATTTAGCGTTAGCGGCGAAGGCGAAG

GTGATGCGACCTATGGTAAACTGACCCTGAAATTTATTTGCACCACCGGTAAACTGCCGGTTCCGTGGCCGACCCTG

GTGACCACCCTGACCTATGGCGTTCAGTGCTTTAGCCGCTATCCGGATCATATGAAACAGCATGATTTCTTTAAAAG

CGCGATGCCGGAAGGCTATGTGCAGGAACGTACCATTTTTTTCAAAGATGATGGCAACTATAAAACCCGTGCGGAAG

TTAAATTTGAAGGCGATACCCTGGTGAACCGCATTGAACTGAAAGGTATTGATTTTAAAGAAGATGGCAACATTCTG

GGTCATAAACTGGAATATAATTACAACAGCCATAATGTGTATATTATGGCCGATAAACAGAAAAATGGCATCAAAGT

GAACTTTAAAATCCGTCACAACATTGAAGATGGTAGCGTGCAGCTGGCGGATCATTATCAGCAGAATACCCCGATTG

GTGATGGCCCGGTGCTGCTGCCGGATAATCATTATCTGAGCACCCAGAGCGCGCTGAGCAAAGATCCGAATGAAAAA

CGTGATCATATGGTGCTGCTGGAATTTGTTACCGCCGCGGGCATTACCCTGGGTATGGATGAACTGTATAAA
```

(LbCas12a (E795L)-GGGGSEAAAKGGGGS-eGFP chimera DNA sequence)

SEQ ID NO: 391

```
ATGAGCAAACTGGAAAAGTTCACCAACTGTTATAGCCTGAGCAAAACCCTGCGTTTTAAAGCAATTCCGGTTGGTAA

AACCCAAGAGAACATTGATAATAAACGCCTGCTGGTCGAAGATGAAAAACGCGCTGAAGATTATAAAGGCGTGAAAA

AACTGCTGGATCGCTATTATCTGAGCTTCATTAACGATGTGCTGCACAGCATTAAACTGAAGAACCTGAACAACTAT

ATCAGCCTGTTTCGTAAAAAAACCCGCACCGAAAAAGAAAACAAAGAGCTGGAAAACCTGGAAATCAATCTGCGTAA

AGAAATCGCCAAAGCGTTTAAAGGTAACGAGGGTTATAAAAGCCTGTTCAAGAAAGACATCATCGAAACCATTCTGC

CGGAATTTCTGGATGATAAAGATGAAATTGCCCTGGTGAATAGCTTTAATGGCTTTACCACCGCATTTACCGGCTTT

TTTGATAATCGCGAAAACATGTTCAGCGAAGAAGCAAAAAGCACCAGCATTGCATTTCGCTGCATTAATGAAAATCT

GACCCGCTACATTAGCAACATGGATATCTTTGAAAAAGTGGACGCGATCTTCGATAAACACGAAGTGCAAGAGATCA

AAGAGAAAATCCTGAACAGCGATTATGACGTCGAAGATTTTTTTGAAGGCGAGTTCTTTAACTTCGTTCTGACCCAA

GAAGGTATCGACGTTTATAACGCAATTATTGGTGGTTTTGTTACCGAAAGCGGTGAGAAAATCAAAGGCCTGAATGA

ATATATCAACCTGTATAACCAGAAAACCAAACAGAAACTGCCGAAATTCAAACCGCTGTATAAACAGGTTCTGAGCG

ATCGTGAAAGCCTGAGCTTTTATGGTGAAGGTTATACCAGTGATGAAGAGGTTCTGGAAGTTTTTCGTAACACCCTG

AATAAAAACAGCGAGATCTTTAGCAGCATCAAAAAGCTTGAGAAACTGTTCAAAAACTTTGATGAGTATAGCAGCGC

AGGCATCTTTGTTAAAAATGGTCCGGCAATTAGCACCATCAGCAAAGATATTTTTGGCGAATGGAATGTGATCCGCG

ATAAATGGAATGCCGAATATGATGATATCCACCTGAAAAAAAAGGCCGTGGTGACCGAGAAATATGAAGATGATCGT

CGTAAAAGCTTCAAGAAAATTGGTAGCTTTAGCCTGGAACAGCTGCAAGAATATGCAGATGCAGATCTGAGCGTTGT

GGAAAAACTGAAAGAAATCATCATTCAGAAGGTGGACGAGATCTATAAAGTTTATGGTAGCAGCGAAAAACTGTTCG

ATGCAGATTTTGTTCTGGAAAAAAGCCTGAAAAAGAATGATGCCGTTGTGGCCATTATGAAAGATCTGCTGGATAGC
```

-continued

```
GTTAAGAGCTTCGAGAATTACATCAAAGCCTTTTTTGGTGAGGGCAAAGAAACCAATCGTGATGAAAGTTTCTATGG
CGATTTTGTGCTGGCCTATGATATTCTGCTGAAAGTGGACCATATTTATGATGCCATTCGCAATTATGTTACCCAGA
AACCGTATAGCAAAGACAAGTTCAAACTGTACTTTCAGAACCCGCAGTTTATGGGTGGTTGGGATAAAGATAAAGAA
ACCGATTATCGTGCCACCATCCTGCGTTATGGTAGTAAATACTATCTGGCCATCATGGACAAAAAATACGCAAAATG
CCTGCAGAAAATCGACAAAGATGATGTGAATGGCAACTATGAAAAAATCAACTACAAACTGCTGCCTGGTCCGAATA
AAATGCTGCCGAAAGTGTTCTTTAGCAAGAAATGGATGGCCTATTATAACCCGAGCGAGGATATTCAAAAGATCTAC
AAAAATGGCACCTTTAAAAAGGGCGACATGTTCAATCTGAACGATTGCCACAAACTGATCGATTTCTTCAAAGATTC
AATTTCGCGTTATCCGAAATGGTCCAATGCCTATGATTTTAACTTTAGCGAAACCGAAAAATACAAAGACATTGCCG
GTTTTTATCGCGAAGTGGAAGAACAGGGCTATAAAGTGAGCTTTGAAAGCGCAAGCAAAAAGAGGTTGATAAGCTG
GTTGAAGAGGGCAAACTGTATATGTTCCAGATTTACAACAAAGATTTTAGCGACAAAAGCCATGGCACCCCGAATCT
GCATACCATGTACTTTAAACTGCTGTTCGACGAAAATAACCATGGTCAGATTCGTCTGAGCGGTGGTGCCGAACTGT
TTATGCGTCGTGCAAGTCTGAAAAAAGAAGAACTGGTTGTTCATCCGGCAAATAGCCCGATTGCAAACAAAAATCCG
GACAATCCGAAAAAAACCACGACACTGAGCTATGATGTGTATAAAGACAAACGTTTTAGCGAGGATCAGTATCTGCT
GCATATCCCGATTGCCATCAATAAATGCCCGAAAAACATCTTTAAGATCAACACCGAAGTTCGCGTGCTGCTGAAAC
ATGATGATAATCCGTATGTGATTGGCATTGATCGTGGTGAACGTAACCTGCTGTATATTGTTGTTGATGGTAAA
GGCAACATCGTGGAACAGTATAGTCTGAACGAAATTATCAACAACTTTAACGGCATCCGCATCAAAACCGACTATCA
TAGCCTGCTGGACAAGAAAGAAAAGAACGTTTTGAAGCACGTCAGAACTGGACCAGTATTGAAAACATCAAAGAAC
TGAAAGCCGGTTATATTAGCCAGGTGGTTCATAAAATCTGTGAGCTGGTAGAAAAATACGATGCAGTTATTGCACTG
GAAGATCTGAATAGCGGTTTCAAAAATAGCCGTGTGAAAGTCGAAAAACAGGTGTATCAGAAATTCGAGAAAATGCT
GATCGACAAACTGAACTACATGGTCGACAAAAAAAGCAATCCGTGTGCAACCGGTGGTGCACTGAAAGGTTATCAGA
TTACCAACAAATTTGAAAGCTTTAAAAGCATGAGCACCCAGAACGGCTTTATCTTCTATATTCCGGCATGGCTGACC
AGCAAAATTGATCCGAGCACCGGTTTTGTGAACCTGCTGAAAACAAAATATACCTCCATTGCCGACAGCAAGAAGTT
TATTAGCAGCTTTGATCGCATTATGTATGTTCCGGAAGAGGACCTGTTTGAATTCGCACTGGATTACAAAAATTTCA
GCCGTACCGATGCCGACTACATCAAAAAATGGAAACTGTACAGCTATGGTAACCGCATTCGCATTTTTCGCAACCCG
AAGAAAAACAATGTGTTCGATTGGGAAGAAGTTTGTCTGACCAGCGCATATAAAGAACTTTTCAACAAATACGGCAT
CAACTATCAGCAGGGTGATATTCGTGCACTGCTGTGTGAACAGAGCGATAAAGCGTTTTATAGCAGTTTTATGGCAC
TGATGAGCCTGATGCTGCAGATGCGTAATAGCATTACCGGTCGCACCGATGTGGATTTTCTGATTAGTCCGGTGAAA
AATTCCGATGGCATCTTTTATGATAGCCGCAATTACGAAGCACAAGAAATGCAATTCTGCCGAAAAACGCAGATGC
AAATGGTGCATATAACATTGCACGTAAAGTTCTGTGGGCAATTGGCCAGTTTAAGAAAGCAGAAGATGAGAAGCTGG
ACAAAGTGAAAATTGCGATCAGCAATAAAGAGTGGCTGGAATACGCACAGACCAGCGTTAAACATGGAGGCGGAGGG
TCGGAAGCGGCAGCAAAGGAGGCGGAGGAAGTATGGTTAGCAAAGGTGAAGAACTGTTTACCGGCGTTGTGCCGAT
TCTGGTGGAACTGGATGGTGATGTGAATGGCCATAAATTTAGCGTTAGCGGCGAAGGCGAAGGTGATGCGACCTATG
GTAAACTGACCCTGAAATTTATTTGCACCACCGGTAAACTGCCGGTTCCGTGGCCGACCCTGGTGACCACCCTGACC
TATGGCGTTCAGTGCTTTAGCCGCTATCCGGATCATATGAAACAGCATGATTTCTTTAAAAGCGCGATGCCGGAAGG
CTATGTGCAGGAACGTACCATTTTTTTCAAAGATGATGGCAACTATAAAACCCGTGCGGAAGTTAAATTTGAAGGCG
ATACCCTGGTGAACCGCATTGAACTGAAAGGTATTGATTTTAAAGAAGATGGCAACATTCTGGGTCATAAACTGGAA
TATAATTACAACAGCCATAATGTGTATATTATGGCCGATAAACAGAAAAATGGCATCAAAGTGAACTTTAAAATCCG
TCACAACATTGAAGATGGTAGCGTGCAGCTGGCGGATCATTATCAGCAGAATACCCCGATTGGTGATGGCCCGGTGC
TGCTGCCGGATAATCATTATCTGAGCACCCAGAGCGCGCTGAGCAAAGATCCGAATGAAAAACGTGATCATATGGTG
CTGCTGGAATTTGTTACCGCCGCGGGCATTACCCTGGGTATGGATGAACTGTATAAA
```

-continued (LbCas12a (E795L)-A(EAAAK)₄A-eGFP chimera DNA sequence)

SEQ ID NO: 392

ATGAGCAAACTGGAAAAGTTCACCAACTGTTATAGCCTGAGCAAAACCCTGCGTTTTAAAGCAATTCCGGTTGGTAA

AACCCAAGAGAACATTGATAATAAACGCCTGCTGGTCGAAGATGAAAAACGCGCTGAAGATTATAAAGGCGTGAAAA

AACTGCTGGATCGCTATTATCTGAGCTTCATTAACGATGTGCTGCACAGCATTAAACTGAAGAACCTGAACAACTAT

ATCAGCCTGTTTCGTAAAAAAACCCGCACCGAAAAAGAAAACAAAGAGCTGGAAAACCTGGAAATCAATCTGCGTAA

AGAAATCGCCAAAGCGTTTAAAGGTAACGAGGGTTATAAAAGCCTGTTCAAGAAAGACATCATCGAAACCATTCTGC

CGGAATTTCTGGATGATAAAGATGAAATTGCCCTGGTGAATAGCTTTAATGGCTTTACCACCGCATTTACCGGCTTT

TTTGATAATCGCGAAAACATGTTCAGCGAAGAAGCAAAAAGCACCAGCATTGCATTTCGCTGCATTAATGAAAATCT

GACCCGCTACATTAGCAACATGGATATCTTTGAAAAAGTGGACGCGATCTTCGATAAACACGAAGTGCAAGAGATCA

AAGAGAAAATCCTGAACAGCGATTATGACGTCGAAGATTTTTTTGAAGGCGAGTTCTTTAACTTCGTTCTGACCCAA

GAAGGTATCGACGTTTATAACGCAATTATTGGTGGTTTTGTTACCGAAAGCGGTGAGAAAATCAAAGGCCTGAATGA

ATATATCAACCTGTATAACCAGAAAACCAAACAGAAACTGCCGAAATTCAAACCGCTGTATAAACAGGTTCTGAGCG

ATCGTGAAAGCCTGAGCTTTTATGGTGAAGGTTATACCAGTGATGAAGAGGTTCTGGAAGTTTTTCGTAACACCCTG

AATAAAAACAGCGAGATCTTTAGCAGCATCAAAAAGCTTGAGAAACTGTTCAAAAACTTTGATGAGTATAGCAGCGC

AGGCATCTTTGTTAAAAATGGTCCGGCAATTAGCACCATCAGCAAAGATATTTTTGGCGAATGGAATGTGATCCGCG

ATAAATGGAATGCCGAATATGATGATATCCACCTGAAAAAAAAGGCCGTGGTGACCGAGAAATATGAAGATGATCGT

CGTAAAAGCTTCAAGAAAATTGGTAGCTTTAGCCTGGAACAGCTGCAAGAATATGCAGATGCAGATCTGAGCGTTGT

GGAAAAAACTGAAAGAAATCATCATTCAGAAGGTGGACGAGATCTATAAAGTTTATGGTAGCAGCGAAAAACTGTTCG

ATGCAGATTTTGTTCTGGAAAAAAGCCTGAAAAAGAATGATGCCGTTGTGGCCATTATGAAAGATCTGCTGGATAGC

GTTAAGAGCTTCGAGAATTACATCAAAGCCTTTTTTGGTGAGGGCAAAGAAACCAATCGTGATGAAAGTTTCTATGG

CGATTTTGTGCTGGCCTATGATATTCTGCTGAAAGTGGACCATATTTATGATGCCATTCGCAATTATGTTACCCAGA

AACCGTATAGCAAAGACAAGTTCAAACTGTACTTTCAGAACCCGCAGTTTATGGGTGGTTGGGATAAAGATAAAGAA

ACCGATTATCGTGCCACCATCCTGCGTTATGGTAGTAAATACTATCTGGCCATCATGGACAAAAAATACGCAAAATG

CCTGCAGAAAATCGACAAAGATGATGTGAATGGCAACTATGAAAAAATCAACTACAAACTGCTGCCTGGTCCGAATA

AAATGCTGCCGAAAGTGTTCTTTAGCAAGAAATGGATGGCCTATTATAACCCGAGCGAGGATATTCAAAAGATCTAC

AAAAATGGCACCTTTAAAAAGGGCGACATGTTCAATCTGAACGATTGCCACAAACTGATCGATTTCTTCAAAGATTC

AATTTCGCGTTATCCGAAATGGTCCAATGCCTATGATTTTAACTTTAGCGAAACCGAAAAATACAAAGACATTGCCG

GTTTTTATCGCGAAGTGGAAGAACAGGGCTATAAAGTGAGCTTTGAAAGCGCAAGCAAAAAAGAGGTTGATAAGCTG

GTTGAAGAGGGCAAACTGTATATGTTCCAGATTTACAACAAAGATTTTAGCGACAAAAGCCATGGCACCCCCGAATCT

GCATACCATGTACTTTAAACTGCTGTTCGACGAAAATAACCATGGTCAGATTCGTCTGAGCGGTGGTGCCGAACTGT

TTATGCGTCGTGCAAGTCTGAAAAAAGAAGAACTGGTTGTTCATCCGGCAAATAGCCCGATTGCAAACAAAAATCCG

GACAATCCGAAAAAAACCACGACACTGAGCTATGATGTGTATAAAGACAAACGTTTTAGCGAGGATCAGTATCTGCT

GCATATCCCGATTGCCATCAATAAATGCCCGAAAAACATCTTTAAGATCAACACCGAAGTTCGCGTGCTGCTGAAAC

ATGATGATAATCCGTATGTGATTGGCATTGATCGTGGTGAACGTAACCTGCTGTATATTGTTGTTGTTGATGGTAAA

GGCAACATCGTGGAACAGTATAGTCTGAACGAAATTATCAACAACTTTAACGGCATCCGCATCAAAACCGACTATCA

TAGCCTGCTGGACAAGAAAGAAAAAGAACGTTTTGAAGCACGTCAGAACTGGACCAGTATTGAAAACATCAAAGAAC

TGAAAGCCGGTTATATTAGCCAGGTGGTTCATAAAATCTGTGAGCTGGTAGAAAAATACGATGCAGTTATTGCACTG

GAAGATCTGAATAGCGGTTTCAAAAATAGCCGTGTGAAAGTCGAAAAACAGGTGTATCAGAAATTCGAGAAAATGCT

GATCGACAAACTGAACTACATGGTCGACAAAAAAAGCAATCCGTGTGCAACCGGTGGTGCACTGAAAGGTTATCAGA

TTACCAACAAATTTGAAAGCTTTAAAAGCATGAGCACCCAGAACGGCTTTATCTTCTATATTCCGGCATGGCTGACC

AGCAAAATTGATCCGAGCACCGGTTTTGTGAACCTGCTGAAAACAAAATATACCTCCATTGCCGACAGCAAGAAGTT

-continued

```
TATTAGCAGCTTTGATCGCATTATGTATGTTCCGGAAGAGGACCTGTTTGAATTCGCACTGGATTACAAAAATTTCA

GCCGTACCGATGCCGACTACATCAAAAAATGGAAACTGTACAGCTATGGTAACCGCATTCGCATTTTTCGCAACCCG

AAGAAAAACAATGTGTTCGATTGGGAAGAAGTTTGTCTGACCAGCGCATATAAAGAACTTTTCAACAAATACGGCAT

CAACTATCAGCAGGGTGATATTCGTGCACTGCTGTGTGAACAGAGCGATAAAGCGTTTTATAGCAGTTTTATGGCAC

TGATGAGCCTGATGCTGCAGATGCGTAATAGCATTACCGGTCGCACCGATGTGGATTTTCTGATTAGTCCGGTGAAA

AATTCCGATGGCATCTTTTATGATAGCCGCAATTACGAAGCACAAGAAAATGCAATTCTGCCGAAAAACGCAGATGC

AAATGGTGCATATAACATTGCACGTAAAGTTCTGTGGGCAATTGGCCAGTTTAAGAAAGCAGAAGATGAGAAGCTGG

ACAAAGTGAAAATTGCGATCAGCAATAAAGAGTGGCTGGAATACGCACAGACCAGCGTTAAACATGCTGAGGCCGCA

GCAAAAGAGGCTGCCGCTAAGGAGGCTGCTGCAAAAGAAGCAGCAGCGAAAGCTATGGTTAGCAAAGGTGAAGAACT

GTTTACCGGCGTTGTGCCGATTCTGGTGGAACTGGATGGTGATGTGAATGGCCATAAATTTAGCGTTAGCGGCGAAG

GCGAAGGTGATGCGACCTATGGTAAACTGACCCTGAAATTTATTTGCACCACCGGTAAACTGCCGGTTCCGTGGCCG

ACCCTGGTGACCACCCTGACCTATGGCGTTCAGTGCTTTAGCCGCTATCCGGATCATATGAAACAGCATGATTTCTT

TAAAAGCGCGATGCCGGAAGGCTATGTGCAGGAACGTACCATTTTTTTCAAAGATGATGGCAACTATAAAACCCGTG

CGGAAGTTAAATTTGAAGGCGATACCCTGGTGAACCGCATTGAACTGAAAGGTATTGATTTTAAAGAAGATGGCAAC

ATTCTGGGTCATAAACTGGAATATAATTACAACAGCCATAATGTGTATATTATGGCCGATAAACAGAAAAATGGCAT

CAAAGTGAACTTTAAAATCCGTCACAACATTGAAGATGGTAGCGTGCAGCTGGCGGATCATTATCAGCAGAATACCC

CGATTGGTGATGGCCCGGTGCTGCTGCCGGATAATCATTATCTGAGCACCCAGAGCGCGCTGAGCAAAGATCCGAAT

GAAAAACGTGATCATATGGTGCTGCTGGAATTTGTTACCGCCGCGGGCATTACCCTGGGTATGGATGAACTGTATAA

A
```

(LbCas12a (E795L)-A(EAAAK)₄ALEA(EAAAK)₄A-eGFP chimera DNA sequence)

SEQ ID NO: 393

```
ATGAGCAAACTGGAAAAGTTCACCAACTGTTATAGCCTGAGCAAAACCCTGCGTTTTAAAGCAATTCCGGTTGGTAA

AACCCAAGAGAACATTGATAATAAACGCCTGCTGGTCGAAGATGAAAAACGCGCTGAAGATTATAAAGGCGTGAAAA

AACTGCTGGATCGCTATTATCTGAGCTTCATTAACGATGTGCTGCACAGCATTAAACTGAAGAACCTGAACAACTAT

ATCAGCCTGTTTCGTAAAAAAACCCGCACCGAAAAGAAAACAAAGAGCTGGAAAACCTGGAAATCAATCTGCGTAA

AGAAATCGCCAAAGCGTTTAAAGGTAACGAGGGTTATAAAAGCCTGTTCAAGAAAGACATCATCGAAACCATTCTGC

CGGAATTTCTGGATGATAAAGATGAAATTGCCCTGGTGAATAGCTTTAATGGCTTTACCACCGCATTTACCGGCTTT

TTTGATAATCGCGAAAACATGTTCAGCGAAGAAGCAAAAGCACCAGCATTGCATTTCGCTGCATTAATGAAAATCT

GACCCGCTACATTAGCAACATGGATATCTTTGAAAAAGTGGACGCGATCTTCGATAAACACGAAGTGCAAGAGATCA

AAGAGAAAATCCTGAACAGCGATTATGACGTCGAAGATTTTTTTGAAGGCGAGTTCTTTAACTTCGTTCTGACCCAA

GAAGGTATCGACGTTTATAACGCAATTATTGGTGGTTTTGTTACCGAAAGCGGTGAGAAAATCAAAGGCCTGAATGA

ATATATCAACCTGTATAACCAGAAAACCAAACAGAAACTGCCGAAATTCAAACCGCTGTATAAACAGGTTCTGAGCG

ATCGTGAAAGCCTGAGCTTTTATGGTGAAGGTTATACCAGTGATGAAGAGGTTCTGGAAGTTTTTCGTAACACCCTG

AATAAAAACAGCGAGATCTTTAGCAGCATCAAAAAGCTTGAGAAACTGTTCAAAAACTTTGATGAGTATAGCAGCGC

AGGCATCTTTGTTAAAAATGGTCCGGCAATTAGCACCATCAGCAAAGATATTTTTGGCGAATGGAATGTGATCCGCG

ATAAATGGAATGCCGAATATGATGATATCCACCTGAAAAAAAAGGCCGTGGTGACCGAGAAATATGAAGATGATCGT

CGTAAAAGCTTCAAGAAAATTGGTAGCTTTAGCCTGGAACAGCTGCAAGAATATGCAGATGCAGATCTGAGCGTTGT

GGAAAAACTGAAAGAAATCATCATTCAGAAGGTGGACGAGATCTATAAAGTTTATGGTAGCAGCGAAAAACTGTTCG

ATGCAGATTTTGTTCTGGAAAAAAGCCTGAAAAAGAATGATGCCGTTGTGGCCATTATGAAAGATCTGCTGGATAGC

GTTAAGAGCTTCGAGAATTACATCAAAGCCTTTTTTGGTGAGGGCAAAGAAACCAATCGTGATGAAAGTTTCTATGG

CGATTTTGTGCTGGCCTATGATATTCTGCTGAAAGTGGACCATATTTATGATGCCATTCGCAATTATGTTACCCAGA
```

-continued

```
AACCGTATAGCAAAGACAAGTTCAAACTGTACTTTCAGAACCCGCAGTTTATGGGTGGTTGGGATAAAGATAAAGAA
ACCGATTATCGTGCCACCATCCTGCGTTATGGTAGTAAATACTATCTGGCCATCATGGACAAAAAATACGCAAAATG
CCTGCAGAAAATCGACAAAGATGATGTGAATGGCAACTATGAAAAAATCAACTACAAACTGCTGCCTGGTCCGAATA
AAATGCTGCCGAAAGTGTTCTTTAGCAAGAAATGGATGGCCTATTATAACCCGAGCGAGGATATTCAAAAGATCTAC
AAAAATGGCACCTTTAAAAAGGGCGACATGTTCAATCTGAACGATTGCCACAAACTGATCGATTTCTTCAAAGATTC
AATTTCGCGTTATCCGAAATGGTCCAATGCCTATGATTTTAACTTTAGCGAAACCGAAAAATACAAAGACATTGCCG
GTTTTTATCGCGAAGTGGAAGAACAGGGCTATAAAGTGAGCTTTGAAAGCGCAAGCAAAAAAGAGGTTGATAAGCTG
GTTGAAGAGGGCAAACTGTATATGTTCCAGATTTACAACAAAGATTTTAGCGACAAAAGCCATGGCACCCCGAATCT
GCATACCATGTACTTTAAACTGCTGTTCGACGAAAATAACCATGGTCAGATTCGTCTGAGCGGTGGTGCCGAACTGT
TTATGCGTCGTGCAAGTCTGAAAAAGAAGAACTGGTTGTTCATCCGGCAAATAGCCCGATTGCAAACAAAAATCCG
GACAATCCGAAAAAACCACGACACTGAGCTATGATGTGTATAAAGACAAACGTTTTAGCGAGGATCAGTATCTGCT
GCATATCCCGATTGCCATCAATAAATGCCCGAAAAACATCTTTAAGATCAACACCGAAGTTCGCGTGCTGCTGAAAC
ATGATGATAATCCGTATGTGATTGGCATTGATCGTGGTGAACGTAACCTGCTGTATATTGTTGTTGTTGATGGTAAA
GGCAACATCGTGGAACAGTATAGTCTGAACGAAATTATCAACAACTTTAACGGCATCCGCATCAAAACCGACTATCA
TAGCCTGCTGGACAAGAAAGAAAAAGAACGTTTTGAAGCACGTCAGAACTGGACCAGTATTGAAAACATCAAAGAAC
TGAAAGCCGGTTATATTAGCCAGGTGGTTCATAAAATCTGTGAGCTGGTAGAAAAATACGATGCAGTTATTGCACTG
GAAGATCTGAATAGCGGTTTCAAAAATAGCCGTGTGAAAGTCGAAAAACAGGTGTATCAGAAATTCGAGAAAATGCT
GATCGACAAACTGAACTACATGGTCGACAAAAAAAGCAATCCGTGTGCAACCGGTGGTGCACTGAAAGGTTATCAGA
TTACCAACAAATTTGAAAGCTTTAAAAGCATGAGCACCCAGAACGGCTTTATCTTCTATATTCCGGCATGGCTGACC
AGCAAAATTGATCCGAGCACCGGTTTTGTGAACCTGCTGAAAACAAAATATACCTCCATTGCCGACAGCAAGAAGTT
TATTAGCAGCTTTGATCGCATTATGTATGTTCCGGAAGAGGACCTGTTTGAATTCGCACTGGATTACAAAAATTTCA
GCCGTACCGATGCCGACTACATCAAAAAATGGAAACTGTACAGCTATGGTAACCGCATTCGCATTTTTCGCAACCCG
AAGAAAAACAATGTGTTCGATTGGGAAGAAGTTTGTCTGACCAGCGCATATAAAGAACTTTTCAACAAATACGGCAT
CAACTATCAGCAGGGTGATATTCGTGCACTGCTGTGTGAACAGAGCGATAAAGCGTTTTATAGCAGTTTTATGGCAC
TGATGAGCCTGATGCTGCAGATGCGTAATAGCATTACCGGTCGCACCGATGTGGATTTTCTGATTAGTCCGGTGAAA
AATTCCGATGGCATCTTTTATGATAGCCGCAATTACGAAGCACAAGAAATGCAATTCTGCCGAAAAACGCAGATGC
AAATGGTGCATATAACATTGCACGTAAAGTTCTGTGGGCAATTGGCCAGTTTAAGAAAGCAGAAGATGAGAAGCTGG
ACAAAGTGAAAATTGCGATCAGCAATAAAGAGTGGCTGGAATACGCACAGACCAGCGTTAAACATGCCGAAGCAGCA
GCCAAAGAAGCTGCCGCAAAGGAGGCGGCAGCTAAAGAAGCGGCCGCTAAGGCATTGGAAGCGGAGGCGGCTGCCAA
GGAGGCTGCGGCGAAAGAAGCTGCGGCCAAAGAAGCGGCTGCAAAAGCGATGGTTAGCAAAGGTGAAGAACTGTTTA
CCGGCGTTGTGCCGATTCTGGTGGAACTGGATGGTGATGTGAATGGCCATAAATTTAGCGTTAGCGGCGAAGGCGAA
GGTGATGCGACCTATGGTAAACTGACCCTGAAATTTATTTGCACCACCGGTAAACTGCCGGTTCCGTGGCCGACCCT
GGTGACCACCCTGACCTATGGCGTTCAGTGCTTTAGCCGCTATCCGGATCATATGAAACAGCATGATTTCTTTAAAA
GCGCGATGCCGGAAGGCTATGTGCAGGAACGTACCATTTTTTTTCAAAGATGATGGCAACTATAAAACCCGTGCGGAA
GTTAAATTTGAAGGCGATACCCTGGTGAACCGCATTGAACTGAAAGGTATTGATTTTAAAGAAGATGGCAACATTCT
GGGTCATAAACTGGAATATAATTACAACAGCCATAATGTGTATATTATGGCCGATAAACAGAAAAATGGCATCAAAG
TGAACTTTAAAATCCGTCACAACATTGAAGATGGTAGCGTGCAGCTGGCGGATCATTATCAGCAGAATACCCCGATT
GGTGATGGCCCGGTGCTGCTGCCGGATAATCATTATCTGAGCACCCAGAGCGCGCTGAGCAAAGATCCGAATGAAAA
ACGTGATCATATGGTGCTGCTGGAATTTGTTACCGCCGCGGGCATTACCCTGGGTATGGATGAACTGTATAAA
```

(LbCas12a (E795L)-LEA(EAAAK)₄ALEA(EAAAK)₄ALE-eGFP chimera DNA sequence)
SEQ ID NO: 394
ATGAGCAAACTGGAAAAGTTCACCAACTGTTATAGCCTGAGCAAAACCCTGCGTTTTAAAGCAATTCCGGTTGGTAA

AACCCAAGAGAACATTGATAATAAACGCCTGCTGGTCGAAGATGAAAAACGCGCTGAAGATTATAAAGGCGTGAAAA

AACTGCTGGATCGCTATTATCTGAGCTTCATTAACGATGTGCTGCACAGCATTAAACTGAAGAACCTGAACAACTAT

ATCAGCCTGTTTCGTAAAAAAACCCGCACCGAAAAGAAAACAAAGAGCTGGAAAACCTGGAAATCAATCTGCGTAA

AGAAATCGCCAAAGCGTTTAAAGGTAACGAGGGTTATAAAAGCCTGTTCAAGAAAGACATCATCGAAACCATTCTGC

CGGAATTTCTGGATGATAAAGATGAAATTGCCCTGGTGAATAGCTTTAATGGCTTTACCACCGCATTTACCGGCTTT

TTTGATAATCGCGAAAACATGTTCAGCGAAGAAGCAAAAAGCACCAGCATTGCATTTCGCTGCATTAATGAAATCT

GACCCGCTACATTAGCAACATGGATATCTTTGAAAAAGTGGACGCGATCTTCGATAAACACGAAGTGCAAGAGATCA

AAGAGAAAATCCTGAACAGCGATTATGACGTCGAAGATTTTTTTGAAGGCGAGTTCTTTAACTTCGTTCTGACCCAA

GAAGGTATCGACGTTTATAACGCAATTATTGGTGGTTTTGTTACCGAAAGCGGTGAGAAAATCAAAGGCCTGAATGA

ATATATCAACCTGTATAACCAGAAAACCAAACAGAAACTGCCGAAATTCAAACCGCTGTATAAACAGGTTCTGAGCG

ATCGTGAAAGCCTGAGCTTTTATGGTGAAGGTTATACCAGTGATGAAGAGGTTCTGGAAGTTTTTCGTAACACCCTG

AATAAAAACAGCGAGATCTTTAGCAGCATCAAAAAGCTTGAGAAACTGTTCAAAAACTTTGATGAGTATAGCAGCGC

AGGCATCTTTGTTAAAAATGGTCCGGCAATTAGCACCATCAGCAAAGATATTTTTGGCGAATGGAATGTGATCCGCG

ATAAATGGAATGCCGAATATGATGATATCCACCTGAAAAAAAAGGCCGTGGTGACCGAGAAATATGAAGATGATCGT

CGTAAAAGCTTCAAGAAAATTGGTAGCTTTAGCCTGGAACAGCTGCAAGAATATGCAGATGCAGATCTGAGCGTTGT

GGAAAAAACTGAAAGAAATCATCATTCAGAAGGTGGACGAGATCTATAAAGTTTATGGTAGCAGCGAAAAACTGTTCG

ATGCAGATTTTGTTCTGGAAAAAAGCCTGAAAAAGAATGATGCCGTTGTGGCCATTATGAAAGATCTGCTGGATAGC

GTTAAGAGCTTCGAGAATTACATCAAAGCCTTTTTTGGTGAGGGCAAAGAAACCAATCGTGATGAAAGTTTCTATGG

CGATTTTGTGCTGGCCTATGATATTCTGCTGAAAGTGGACCATATTTATGATGCCATTCGCAATTATGTTACCCAGA

AACCGTATAGCAAAGACAAGTTCAAACTGTACTTTCAGAACCCGCAGTTTATGGGTGGTTGGGATAAAGATAAGAA

ACCGATTATCGTGCCACCATCCTGCGTTATGGTAGTAAATACTATCTGGCCATCATGGACAAAAAATACGCAAAATG

CCTGCAGAAAATCGACAAAGATGATGTGAATGGCAACTATGAAAAAATCAACTACAAACTGCTGCCTGGTCCGAATA

AAATGCTGCCGAAAGTGTTCTTTAGCAAGAAATGGATGGCCTATTATAACCCGAGCGAGGATATTCAAAAGATCTAC

AAAAATGGCACCTTTAAAAAGGGCGACATGTTCAATCTGAACGATTGCCACAAACTGATCGATTTCTTCAAAGATTC

AATTTCGCGTTATCCGAAATGGTCCAATGCCTATGATTTTAACTTTAGCGAAACCGAAAAATACAAAGACATTGCCG

GTTTTTATCGCGAAGTGGAAGAACAGGGCTATAAAGTGAGCTTTGAAAGCGCAAGCAAAAAGAGGTTGATAAGCTG

GTTGAAGAGGGCAAACTGTATATGTTCCAGATTTACAACAAAGATTTTAGCGACAAAAGCCATGGCACCCCGAATCT

GCATACCATGTACTTTAAACTGCTGTTCGACGAAAATAACCATGGTCAGATTCGTCTGAGCGGTGGTGCCGAACTGT

TTATGCGTCGTGCAAGTCTGAAAAAAGAAGAACTGGTTGTTCATCCGGCAAATAGCCCGATTGCAAACAAAAATCCG

GACAATCCGAAAAAAACCACGACACTGAGCTATGATGTGTATAAAGACAAACGTTTTAGCGAGGATCAGTATCTGCT

GCATATCCCGATTGCCATCAATAAATGCCCGAAAAACATCTTTAAGATCAACACCGAAGTTCGCGTGCTGCTGAAAC

ATGATGATAATCCGTATGTGATTGGCATTGATCGTGGTGAACGTAACCTGCTGTATATTGTTGTTGATGGTAAA

GGCAACATCGTGGAACAGTATAGTCTGAACGAAATTATCAACAACTTTAACGGCATCCGCATCAAAACCGACTATCA

TAGCCTGCTGGACAAGAAGAAAAGAACGTTTTGAAGCACGTCAGAACTGGACCAGTATTGAAAACATCAAAGAAC

TGAAAGCCGGTTATATTAGCCAGGTGGTTCATAAAATCTGTGAGCTGGTAGAAAAATACGATGCAGTTATTGCACTG

GAAGATCTGAATAGCGGTTTCAAAAATAGCCGTGTGAAAGTCGAAAAACAGGTGTATCAGAAATTCGAGAAAATGCT

GATCGACAAACTGAACTACATGGTCGACAAAAAAAGCAATCCGTGTGCAACCGGTGGTGCACTGAAAGGTTATCAGA

TTACCAACAAATTTGAAAGCTTTAAAAGCATGAGCACCCAGAACGGCTTTATCTTCTATATTCCGGCATGGCTGACC

-continued

AGCAAAATTGATCCGAGCACCGGTTTTGTGAACCTGCTGAAAACAAAATATACCTCCATTGCCGACAGCAAGAAGTT
TATTAGCAGCTTTGATCGCATTATGTATGTTCCGGAAGAGGACCTGTTTGAATTCGCACTGGATTACAAAAATTTCA
GCCGTACCGATGCCGACTACATCAAAAAATGGAAACTGTACAGCTATGGTAACCGCATTCGCATTTTTCGCAACCCG
AAGAAAAACAATGTGTTCGATTGGGAAGAAGTTTGTCTGACCAGCGCATATAAAGAACTTTTCAACAAATACGGCAT
CAACTATCAGCAGGGTGATATTCGTGCACTGCTGTGTGAACAGAGCGATAAAGCGTTTTATAGCAGTTTTATGGCAC
TGATGAGCCTGATGCTGCAGATGCGTAATAGCATTACCGGTCGCACCGATGTGGATTTTCTGATTAGTCCGGTGAAA
AATTCCGATGGCATCTTTTATGATAGCCGCAATTACGAAGCACAAGAAAATGCAATTCTGCCGAAAAACGCAGATGC
AAATGGTGCATATAACATTGCACGTAAAGTTCTGTGGGCAATTGGCCAGTTTAAGAAAGCAGAAGATGAGAAGCTGG
ACAAAGTGAAAATTGCGATCAGCAATAAAGAGTGGCTGGAATACGCACAGACCAGCGTTAAACATTTAGAGGCTGAG
GCTGCTGCCAAGGAGGCTGCTGCGAAGGAAGCTGCAGCTAAAGAGGCAGCGGCCAAAGCACTTGAGGCCGAAGCCGC
CGCGAAAGAAGCCGCTGCTAAGGAGGCAGCCGCCAAAGAAGCGGCAGCTAAAGCATTAGAAATGGTTAGCAAAGGTG
AAGAACTGTTTACCGGCGTTGTGCCGATTCTGGTGGAACTGGATGGTGATGTGAATGGCCATAAATTTAGCGTTAGC
GGCGAAGGCGAAGGTGATGCGACCTATGGTAAACTGACCCTGAAATTTATTTGCACCACCGGTAAACTGCCGGTTCC
GTGGCCGACCCTGGTGACCACCCTGACCTATGGCGTTCAGTGCTTTAGCCGCTATCCGGATCATATGAAACAGCATG
ATTTCTTTAAAAGCGCGATGCCGGAAGGCTATGTGCAGGAACGTACCATTTTTTTCAAAGATGATGGCAACTATAAA
ACCCGTGCGGAAGTTAAATTTGAAGGCGATACCCTGGTGAACCGCATTGAACTGAAAGGTATTGATTTTAAAGAAGA
TGGCAACATTCTGGGTCATAAACTGGAATATAATTACAACAGCCATAATGTGTATATTATGGCCGATAAACAGAAAA
ATGGCATCAAAGTGAACTTTAAAATCCGTCACAACATTGAAGATGGTAGCGTGCAGCTGGCGGATCATTATCAGCAG
AATACCCCGATTGGTGATGGCCCGGTGCTGCTGCCGGATAATCATTATCTGAGCACCCAGAGCGCGCTGAGCAAAGA
TCCGAATGAAAACGTGATCATATGGTGCTGCTGGAATTTGTTACCGCCGCGGGCATTACCCTGGGTATGGATGAAC
TGTATAAA (LbCas12a (E795L)-APA-eGFP chimera DNA sequence)

SEQ ID NO: 395

ATGAGCAAACTGGAAAAGTTCACCAACTGTTATAGCCTGAGCAAAACCCTGCGTTTTAAAGCAATTCCGGTTGGTAA
AACCCAAGAGAACATTGATAATAAACGCCTGCTGGTCGAAGATGAAAAACGCGCTGAAGATTATAAAGGCGTGAAAA
AACTGCTGGATCGCTATTATCTGAGCTTCATTAACGATGTGCTGCACAGCATTAAACTGAAGAACCTGAACAACTAT
ATCAGCCTGTTTCGTAAAAAAACCCGCACCGAAAAAGAAAACAAAGAGCTGGAAAACCTGGAAATCAATCTGCGTAA
AGAAATCGCCAAAGCGTTTAAAGGTAACGAGGGTTATAAAAGCCTGTTCAAGAAAGACATCATCGAAACCATTCTGC
CGGAATTTCTGGATGATAAAGATGAAATTGCCCTGGTGAATAGCTTTAATGGCTTTACCACCGCATTTACCGGCTTT
TTTGATAATCGCGAAAACATGTTCAGCGAAGAAGCAAAAAGCACCAGCATTGCATTTCGCTGCATTAATGAAAATCT
GACCCGCTACATTAGCAACATGGATATCTTTGAAAAAGTGGACGCGATCTTCGATAAACACGAAGTGCAAGAGATCA
AAGAGAAAATCCTGAACAGCGATTATGACGTCGAAGATTTTTTTGAAGGCGAGTTCTTTAACTTCGTTCTGACCCAA
GAAGGTATCGACGTTTATAACGCAATTATTGGTGGTTTTGTTACCGAAAGCGGTGAGAAAATCAAAGGCCTGAATGA
ATATATCAACCTGTATAACCAGAAAACCAAACAGAAACTGCCGAAATTCAAACCGCTGTATAAACAGGTTCTGAGCG
ATCGTGAAAGCCTGAGCTTTTATGGTGAAGGTTATACCAGTGATGAAGAGGTTCTGGAAGTTTTTCGTAACACCCTG
AATAAAAACAGCGAGATCTTTAGCAGCATCAAAAAGCTTGAGAAACTGTTCAAAAACTTTGATGAGTATAGCAGCGC
AGGCATCTTTGTTAAAAATGGTCCGGCAATTAGCACCATCAGCAAAGATATTTTTGGCGAATGGAATGTGATCCGCG
ATAAATGGAATGCCGAATATGATGATATCCACCTGAAAAAAAAGGCCGTGGTGACCGAGAAATATGAAGATGATCGT
CGTAAAAGCTTCAAGAAAATTGGTAGCTTTAGCCTGGAACAGCTGCAAGAATATGCAGATGCAGATCTGAGCGTTGT
GGAAAAAACTGAAAGAAATCATCATTCAGAAGGTGGACGAGATCTATAAAGTTTATGGTAGCAGCGAAAAACTGTTCG
ATGCAGATTTTGTTCTGGAAAAAAGCCTGAAAAAGAATGATGCCGTTGTGGCCATTATGAAAGATCTGCTGGATAGC
GTTAAGAGCTTCGAGAATTACATCAAAGCCTTTTTTGGTGAGGGCAAAGAAACCAATCGTGATGAAAGTTTCTATGG

-continued

```
CGATTTTGTGCTGGCCTATGATATTCTGCTGAAAGTGGACCATATTTATGATGCCATTCGCAATTATGTTACCCAGA

AACCGTATAGCAAAGACAAGTTCAAACTGTACTTTCAGAACCCGCAGTTTATGGGTGGTTGGGATAAAGATAAAGAA

ACCGATTATCGTGCCACCATCCTGCGTTATGGTAGTAAATACTATCTGGCCATCATGGACAAAAAATACGCAAAATG

CCTGCAGAAAATCGACAAAGATGATGTGAATGGCAACTATGAAAAATCAACTACAAACTGCTGCCTGGTCCGAATA

AAATGCTGCCGAAAGTGTTCTTTAGCAAGAAATGGATGGCCTATTATAACCCGAGCGAGGATATTCAAAAGATCTAC

AAAAATGGCACCTTTAAAAAGGGCGACATGTTCAATCTGAACGATTGCCACAAACTGATCGATTTCTTCAAAGATTC

AATTTCGCGTTATCCGAAATGGTCCAATGCCTATGATTTTAACTTTAGCGAAACCGAAAAATACAAAGACATTGCCG

GTTTTTATCGCGAAGTGGAAGAACAGGGCTATAAAGTGAGCTTTGAAAGCGCAAGCAAAAAAGAGGTTGATAAGCTG

GTTGAAGAGGGCAAACTGTATATGTTCCAGATTTACAACAAAGATTTTAGCGACAAAAGCCATGGCACCCCGAATCT

GCATACCATGTACTTTAAACTGCTGTTCGACGAAAATAACCATGGTCAGATTCGTCTGAGCGGTGGTGCCGAACTGT

TTATGCGTCGTGCAAGTCTGAAAAAGAAGAACTGGTTGTTCATCCGGCAAATAGCCCGATTGCAAACAAAAATCCG

GACAATCCGAAAAAACCACGACACTGAGCTATGATGTGTATAAAGACAAACGTTTTAGCGAGGATCAGTATCTGCT

GCATATCCCGATTGCCATCAATAAATGCCCGAAAAACATCTTTAAGATCAACACCGAAGTTCGCGTGCTGCTGAAAC

ATGATGATAATCCGTATGTGATTGGCATTGATCGTGGTAACGTAACCTGCTGTATATTGTTGTTGTTGATGGTAAA

GGCAACATCGTGGAACAGTATAGTCTGAACGAAATTATCAACAACTTTAACGGCATCCGCATCAAAACCGACTATCA

TAGCCTGCTGGACAAGAAAGAAAAAGAACGTTTTGAAGCACGTCAGAACTGGACCAGTATTGAAAACATCAAAGAAC

TGAAAGCCGGTTATATTAGCCAGGTGGTTCATAAAATCTGTGAGCTGGTAGAAAAATACGATGCAGTTATTGCACTG

GAAGATCTGAATAGCGGTTTCAAAAATAGCCGTGTGAAAGTCGAAAAACAGGTGTATCAGAAATTCGAGAAAATGCT

GATCGACAAACTGAACTACATGGTCGACAAAAAAAGCAATCCGTGTGCAACCGGTGGTGCACTGAAAGGTTATCAGA

TTACCAACAAATTTGAAAGCTTTAAAAGCATGAGCACCCAGAACGGCTTTATCTTCTATATTCCGGCATGGCTGACC

AGCAAAATTGATCCGAGCACCGGTTTTGTGAACCTGCTGAAAACAAAATATACCTCCATTGCCGACAGCAAGAAGTT

TATTAGCAGCTTTGATCGCATTATGTATGTTCCGGAAGAGGACCTGTTTGAATTCGCACTGGATTACAAAAATTTCA

GCCGTACCGATGCCGACTACATCAAAAAATGGAAACTGTACAGCTATGGTAACCGCATTCGCATTTTTCGCAACCCG

AAGAAAAACAATGTGTTCGATTGGGAAGAAGTTTGTCTGACCAGCGCATATAAAGAACTTTTCAACAAATACGGCAT

CAACTATCAGCAGGGTGATATTCGTGCACTGCTGTGTGAACAGAGCGATAAAGCGTTTTATAGCAGTTTTATGGCAC

TGATGAGCCTGATGCTGCAGATGCGTAATAGCATTACCGGTCGCACCGATGTGGATTTTCTGATTAGTCCGGTGAAA

AATTCCGATGGCATCTTTTATGATAGCCGCAATTACGAAGCACAAGAAATGCAATTCTGCCGAAAAACGCAGATGC

AAATGGTGCATATAACATTGCACGTAAAGTTCTGTGGGCAATTGGCCAGTTTAAGAAAGCAGAAGATGAGAAGCTGG

ACAAAGTGAAAATTGCGATCAGCAATAAAGAGTGGCTGGAATACGCACAGACCAGCGTTAAACATGCACCTGCGATG

GTTAGCAAAGGTGAAGAACTGTTTACCGGCGTTGTGCCGATTCTGGTGGAACTGGATGGTGATGTGAATGGCCATAA

ATTTAGCGTTAGCGGCGAAGGCGAAGGTGATGCGACCTATGGTAAACTGACCCTGAAATTTATTTGCACCACCGGTA

AACTGCCGGTTCCGTGGCCGACCCTGGTGACCACCCTGACCTATGGCGTTCAGTGCTTTAGCCGCTATCCGGATCAT

ATGAAACAGCATGATTTCTTTAAAAGCGCGATGCCGGAAGGCTATGTGCAGGAACGTACCATTTTTTTCAAAGATGA

TGGCAACTATAAAACCCGTGCGGAAGTTAAATTTGAAGGCGATACCCTGGTGAACCGCATTGAACTGAAAGGTATTG

ATTTTAAGAAGATGGCAACATTCTGGGTCATAAACTGGAATATAATTACAACAGCCATAATGTGTATATTATGGCC

GATAAACAGAAAAATGGCATCAAAGTGAACTTTAAAATCCGTCACAACATTGAAGATGGTAGCGTGCAGCTGGCGGA

TCATTATCAGCAGAATACCCCGATTGGTGATGGCCCGGTGCTGCTGCCGGATAATCATTATCTGAGCACCCAGAGCG

CGCTGAGCAAAGATCCGAATGAAAAACGTGATCATATGGTGCTGCTGGAATTTGTTACCGCCGCGGGCATTACCCTG

GGTATGGATGAACTGTATAAA
```

(LbCas12a (E795L)-APAPA-eGFP chimera DNA sequence)
SEQ ID NO: 396

ATGAGCAAACTGGAAAAGTTCACCAACTGTTATAGCCTGAGCAAAACCCTGCGTTTTAAAGCAATTCCGGTTGGTAA

AACCCAAGAGAACATTGATAATAAACGCCTGCTGGTCGAAGATGAAAAACGCGCTGAAGATTATAAAGGCGTGAAAA

AACTGCTGGATCGCTATTATCTGAGCTTCATTAACGATGTGCTGCACAGCATTAAACTGAAGAACCTGAACAACTAT

ATCAGCCTGTTTCGTAAAAAAACCCGCACCGAAAAGAAAACAAAGAGCTGGAAAACCTGGAAATCAATCTGCGTAA

AGAAATCGCCAAAGCGTTTAAAGGTAACGAGGGTTATAAAAGCCTGTTCAAGAAAGACATCATCGAAACCATTCTGC

CGGAATTTCTGGATGATAAAGATGAAATTGCCCTGGTGAATAGCTTTAATGGCTTTACCACCGCATTTACCGGCTTT

TTTGATAATCGCGAAAACATGTTCAGCGAAGAAGCAAAAAGCACCAGCATTGCATTTCGCTGCATTAATGAAATCT

GACCCGCTACATTAGCAACATGGATATCTTTGAAAAAGTGGACGCGATCTTCGATAAACACGAAGTGCAAGAGATCA

AAGAGAAATCCTGAACAGCGATTATGACGTCGAAGATTTTTTTGAAGGCGAGTTCTTTAACTTCGTTCTGACCCAA

GAAGGTATCGACGTTTATAACGCAATTATTGGTGGTTTTGTTACCGAAAGCGGTGAGAAAATCAAAGGCCTGAATGA

ATATATCAACCTGTATAACCAGAAAACCAAACAGAAACTGCCGAAATTCAAACCGCTGTATAAACAGGTTCTGAGCG

ATCGTGAAAGCCTGAGCTTTTATGGTGAAGGTTATACCAGTGATGAAGAGGTTCTGGAAGTTTTTCGTAACACCCTG

AATAAAAACAGCGAGATCTTTAGCAGCATCAAAAAGCTTGAGAAACTGTTCAAAAACTTTGATGAGTATAGCAGCGC

AGGCATCTTTGTTAAAAATGGTCCGGCAATTAGCACCATCAGCAAAGATATTTTTGGCGAATGGAATGTGATCCGCG

ATAAATGGAATGCCGAATATGATGATATCCACCTGAAAAAAAAGGCCGTGGTGACCGAGAAATATGAAGATGATCGT

CGTAAAAGCTTCAAGAAAATTGGTAGCTTTAGCCTGGAACAGCTGCAAGAATATGCAGATGCAGATCTGAGCGTTGT

GGAAAAACTGAAAGAAATCATCATTCAGAAGGTGGACGAGATCTATAAAGTTTATGGTAGCAGCGAAAAACTGTTCG

ATGCAGATTTTGTTCTGGAAAAAAGCCTGAAAAAGAATGATGCCGTTGTGGCCATTATGAAAGATCTGCTGGATAGC

GTTAAGAGCTTCGAGAATTACATCAAAGCCTTTTTTGGTGAGGGCAAAGAAACCAATCGTGATGAAAGTTTCTATGG

CGATTTTGTGCTGGCCTATGATATTCTGCTGAAAGTGGACCATATTTATGATGCCATTCGCAATTATGTTACCCAGA

AACCGTATAGCAAAGACAAGTTCAAACTGTACTTTCAGAACCCGCAGTTTATGGGTGGTTGGGATAAAGATAAGAA

ACCGATTATCGTGCCACCATCCTGCGTTATGGTAGTAAATACTATCTGGCCATCATGGACAAAAAATACGCAAATG

CCTGCAGAAAATCGACAAAGATGATGTGAATGGCAACTATGAAAAATCAACTACAAACTGCTGCCTGGTCCGAATA

AAATGCTGCCGAAAGTGTTCTTTAGCAAGAAATGGATGGCCTATTATAACCCGAGCGAGGATATTCAAAAGATCTAC

AAAAATGGCACCTTTAAAAAGGGCGACATGTTCAATCTGAACGATTGCCACAAACTGATCGATTTCTTCAAAGATTC

AATTTCGCGTTATCCGAAATGGTCCAATGCCTATGATTTTAACTTTAGCGAAACCGAAAAATACAAAGACATTGCCG

GTTTTTATCGCGAAGTGGAAGAACAGGGCTATAAAGTGAGCTTTGAAAGCGCAAGCAAAAAAGAGGTTGATAAGCTG

GTTGAAGAGGGCAAACTGTATATGTTCCAGATTTACAACAAAGATTTTAGCGACAAAAGCCATGGCACCCCGAATCT

GCATACCATGTACTTTAAACTGCTGTTCGACGAAAATAACCATGGTCAGATTCGTCTGAGCGGTGGTGCCGAACTGT

TTATGCGTCGTGCAAGTCTGAAAAAAGAAGAACTGGTTGTTCATCCGGCAAATAGCCCGATTGCAAACAAAAATCCG

GACAATCCGAAAAAAACCACGACACTGAGCTATGATGTGTATAAAGACAAACGTTTTAGCGAGGATCAGTATCTGCT

GCATATCCCGATTGCCATCAATAAATGCCCGAAAAACATCTTTAAGATCAACACCGAAGTTCGCGTGCTGCTGAAAC

ATGATGATAATCCGTATGTGATTGGCATTGATCGTGGTGAACGTAACCTGCTGTATATTGTTGTTGTTGATGGTAAA

GGCAACATCGTGGAACAGTATAGTCTGAACGAAATTATCAACAACTTTAACGGCATCCGCATCAAAACCGACTATCA

TAGCCTGCTGGACAAGAAGAAAAAGAACGTTTTGAAGCACGTCAGAACTGGACCAGTATTGAAAACATCAAAGAAC

TGAAAGCCGGTTATATTAGCCAGGTGGTTCATAAAATCTGTGAGCTGGTAGAAAAATACGATGCAGTTATTGCACTG

GAAGATCTGAATAGCGGTTTCAAAAATAGCCGTGTGAAAGTCGAAAAACAGGTGTATCAGAAATTCGAGAAAATGCT

GATCGACAAACTGAACTACATGGTCGACAAAAAAAGCAATCCGTGTGCAACCGGTGGTGCACTGAAAGGTTATCAGA

TTACCAACAAATTTGAAAGCTTTAAAAGCATGAGCACCCAGAACGGCTTTATCTTCTATATTCCGGCATGGCTGACC

-continued

AGCAAAATTGATCCGAGCACCGGTTTTGTGAACCTGCTGAAAACAAAATATACCTCCATTGCCGACAGCAAGAAGTT
TATTAGCAGCTTTGATCGCATTATGTATGTTCCGGAAGAGGACCTGTTTGAATTCGCACTGGATTACAAAAATTTCA
GCCGTACCGATGCCGACTACATCAAAAAATGGAAACTGTACAGCTATGGTAACCGCATTCGCATTTTTCGCAACCCG
AAGAAAAACAATGTGTTCGATTGGGAAGAAGTTTGTCTGACCAGCGCATATAAAGAACTTTTCAACAAATACGGCAT
CAACTATCAGCAGGGTGATATTCGTGCACTGCTGTGTGAACAGAGCGATAAAGCGTTTTATAGCAGTTTTATGGCAC
TGATGAGCCTGATGCTGCAGATGCGTAATAGCATTACCGGTCGCACCGATGTGGATTTTCTGATTAGTCCGGTGAAA
AATTCCGATGGCATCTTTTATGATAGCCGCAATTACGAAGCACAAGAAATGCAATTCTGCCGAAAAACGCAGATGC
AAATGGTGCATATAACATTGCACGTAAAGTTCTGTGGGCAATTGGCCAGTTTAAGAAAGCAGAAGATGAGAAGCTGG
ACAAAGTGAAAATTGCGATCAGCAATAAAGAGTGGCTGGAATACGCACAGACCAGCGTTAAACATGCTCCTGCACCT
GCGATGGTTAGCAAAGGTGAAGAACTGTTTACCGGCGTTGTGCCGATTCTGGTGGAACTGGATGGTGATGTGAATGG
CCATAAATTTAGCGTTAGCGGCGAAGGCGAAGGTGATGCGACCTATGGTAAACTGACCCTGAAATTTATTTGCACCA
CCGGTAAACTGCCGGTTCCGTGGCCGACCCTGGTGACCACCCTGACCTATGGCGTTCAGTGCTTTAGCCGCTATCCG
GATCATATGAAACAGCATGATTTCTTTAAAAGCGCGATGCCGGAAGGCTATGTGCAGGAACGTACCATTTTTTTCAA
AGATGATGGCAACTATAAAACCCGTGCGGAAGTTAAATTTGAAGGCGATACCCTGGTGAACCGCATTGAACTGAAAG
GTATTGATTTTAAAGAAGATGGCAACATTCTGGGTCATAAACTGGAATATAATTACAACAGCCATAATGTGTATATT
ATGGCCGATAAACAGAAAAATGGCATCAAAGTGAACTTTAAAATCCGTCACAACATTGAAGATGGTAGCGTGCAGCT
GGCGGATCATTATCAGCAGAATACCCCGATTGGTGATGGCCCGGTGCTGCTGCCGGATAATCATTATCTGAGCACCC
AGAGCGCGCTGAGCAAAGATCCGAATGAAAAACGTGATCATATGGTGCTGCTGGAATTTGTTACCGCCGCGGGCATT
ACCCTGGGTATGGATGAACTGTATAAA (LbCas12a (E795L)-APAPAPA-eGFP chimera DNA sequence)

SEQ ID NO: 397
ATGAGCAAACTGGAAAAGTTCACCAACTGTTATAGCCTGAGCAAAACCCTGCGTTTTAAAGCAATTCCGGTTGGTAA
AACCCAAGAGAACATTGATAATAAACGCCTGCTGGTCGAAGATGAAAAACGCGCTGAAGATTATAAAGGCGTGAAAA
AACTGCTGGATCGCTATTATCTGAGCTTCATTAACGATGTGCTGCACAGCATTAAACTGAAGAACCTGAACAACTAT
ATCAGCCTGTTTCGTAAAAAAACCCGCACCGAAAAAGAAAACAAAGAGCTGGAAAACCTGGAAATCAATCTGCGTAA
AGAAATCGCCAAAGCGTTTAAAGGTAACGAGGGTTATAAAAGCCTGTTCAAGAAAGACATCATCGAAACCATTCTGC
CGGAATTTCTGGATGATAAAGATGAAATTGCCCTGGTGAATAGCTTTAATGGCTTTACCACCGCATTTACCGGCTTT
TTTGATAATCGCGAAAACATGTTCAGCGAAGAAGCAAAAAGCACCAGCATTGCATTTCGCTGCATTAATGAAAATCT
GACCCGCTACATTAGCAACATGGATATCTTTGAAAAAGTGGACGCGATCTTCGATAAACACGAAGTGCAAGAGATCA
AAGAGAAATCCTGAACAGCGATTATGACGTCGAAGATTTTTTTGAAGGCGAGTTCTTTAACTTCGTTCTGACCCAA
GAAGGTATCGACGTTTATAACGCAATTATTGGTGGTTTTGTTACCGAAAGCGGTGAGAAAATCAAAGGCCTGAATGA
ATATATCAACCTGTATAACCAGAAAACCAAACAGAAACTGCCGAAATTCAAACCGCTGTATAAACAGGTTCTGAGCG
ATCGTGAAAGCCTGAGCTTTTATGGTGAAGGTTATACCAGTGATGAAGAGGTTCTGGAAGTTTTTCGTAACACCCTG
AATAAAAACAGCGAGATCTTTAGCAGCATCAAAAAGCTTGAGAAACTGTTCAAAAACTTTGATGAGTATAGCAGCGC
AGGCATCTTTGTTAAAAATGGTCCGGCAATTAGCACCATCAGCAAAGATATTTTTGGCGAATGGAATGTGATCCGCG
ATAAATGGAATGCCGAATATGATGATATCCACCTGAAAAAAAGGCCGTGGTGACCGAGAAATATGAAGATGATCGT
CGTAAAAGCTTCAAGAAAATTGGTAGCTTTAGCCTGGAACAGCTGCAAGAATATGCAGATGCAGATCTGAGCGTTGT
GGAAAAACTGAAAGAAATCATCATTCAGAAGGTGGACGAGATCTATAAAGTTTATGGTAGCAGCGAAAAACTGTTCG
ATGCAGATTTTGTTCTGGAAAAAGCCTGAAAAGAATGATGCCGTTGTGGCCATTATGAAAGATCTGCTGGATAGC
GTTAAGAGCTTCGAGAATTACATCAAAGCCTTTTTTGGTGAGGGCAAAGAAACCAATCGTGATGAAAGTTTCTATGG
CGATTTTGTGCTGGCCTATGATATTCTGCTGAAAGTGGACCATATTTATGATGCCATTCGCAATTATGTTACCCAGA
AACCGTATAGCAAAGACAAGTTCAAACTGTACTTTCAGAACCCGCAGTTTATGGGTGGTTGGGATAAAGATAAAGAA

-continued

ACCGATTATCGTGCCACCATCCTGCGTTATGGTAGTAAATACTATCTGGCCATCATGGACAAAAAATACGCAAAATG

CCTGCAGAAAATCGACAAAGATGATGTGAATGGCAACTATGAAAAAATCAACTACAAACTGCTGCCTGGTCCGAATA

AAAATGCTGCCGAAAGTGTTCTTTAGCAAGAAATGGATGGCCTATTATAACCCGAGCGAGGATATTCAAAAGATCTAC

AAAAATGGCACCTTTAAAAAGGGCGACATGTTCAATCTGAACGATTGCCACAAACTGATCGATTTCTTCAAAGATTC

AATTTCGCGTTATCCGAAATGGTCCAATGCCTATGATTTTAACTTTAGCGAAACCGAAAAATACAAAGACATTGCCG

GTTTTTATCGCGAAGTGGAAGAACAGGGCTATAAAGTGAGCTTTGAAAGCGCAAGCAAAAAAGAGGTTGATAAGCTG

GTTGAAGAGGGCAAACTGTATATGTTCCAGATTTACAACAAAGATTTTAGCGACAAAAGCCATGGCACCCCGAATCT

GCATACCATGTACTTTAAACTGCTGTTCGACGAAAATAACCATGGTCAGATTCGTCTGAGCGGTGGTGCCGAACTGT

TTATGCGTCGTGCAAGTCTGAAAAAGAAGAACTGGTTGTTCATCCGGCAAATAGCCCGATTGCAAACAAAAATCCG

GACAATCCGAAAAAAACCACGACACTGAGCTATGATGTGTATAAAGACAAACGTTTTAGCGAGGATCAGTATCTGCT

GCATATCCCGATTGCCATCAATAAATGCCCGAAAAACATCTTTAAGATCAACACCGAAGTTCGCGTGCTGCTGAAAC

ATGATGATAATCCGTATGTGATTGGCATTGATCGTGGTGAACGTAACCTGCTGTATATTGTTGTTGTTGATGGTAAA

GGCAACATCGTGGAACAGTATAGTCTGAACGAAATTATCAACAACTTTAACGGCATCCGCATCAAAACCGACTATCA

TAGCCTGCTGGACAAGAAAGAAAAAGAACGTTTTGAAGCACGTCAGAACTGGACCAGTATTGAAAACATCAAAGAAC

TGAAAGCCGGTTATATTAGCCAGGTGGTTCATAAAATCTGTGAGCTGGTAGAAAAATACGATGCAGTTATTGCACTG

GAAGATCTGAATAGCGGTTTCAAAAATAGCCGTGTGAAAGTCGAAAAACAGGTGTATCAGAAATTCGAGAAAATGCT

GATCGACAAACTGAACTACATGGTCGACAAAAAAAGCAATCCGTGTGCAACCGGTGGTGCACTGAAAGGTTATCAGA

TTACCAACAAATTTGAAAGCTTTAAAAGCATGAGCACCCAGAACGGCTTTATCTTCTATATTCCGGCATGGCTGACC

AGCAAAATTGATCCGAGCACCGGTTTTGTGAACCTGCTGAAAACAAAATATACCTCCATTGCCGACAGCAAGAAGTT

TATTAGCAGCTTTGATCGCATTATGTATGTTCCGGAAGAGGACCTGTTTGAATTCGCACTGGATTACAAAAATTTCA

GCCGTACCGATGCCGACTACATCAAAAAATGGAAACTGTACAGCTATGGTAACCGCATTCGCATTTTTCGCAACCCG

AAGAAAAACAATGTGTTCGATTGGGAAGAAGTTTGTCTGACCAGCGCATATAAAGAACTTTTCAACAAATACGGCAT

CAACTATCAGCAGGGTGATATTCGTGCACTGCTGTGTGAACAGAGCGATAAAGCGTTTTATAGCAGTTTTATGGCAC

TGATGAGCCTGATGCTGCAGATGCGTAATAGCATTACCGGTCGCACCGATGTGGATTTTCTGATTAGTCCGGTGAAA

AATTCCGATGGCATCTTTTATGATAGCCGCAATTACGAAGCACAAGAAAATGCAATTCTGCCGAAAAACGCAGATGC

AAATGGTGCATATAACATTGCACGTAAAGTTCTGTGGGCAATTGGCCAGTTTAAGAAAGCAGAAGATGAGAAGCTGG

ACAAAGTGAAAATTGCGATCAGCAATAAAGAGTGGCTGGAATACGCACAGACCAGCGTTAAACATGCGCCAGCTCCT

GCACCTGCGATGGTTAGCAAAGGTGAAGAACTGTTTACCGGCGTTGTGCCGATTCTGGTGGAACTGGATGGTGATGT

GAATGGCCATAAATTTAGCGTTAGCGGCGAAGGCGAAGGTGATGCGACCTATGGTAAACTGACCCTGAAATTTATTT

GCACCACCGGTAAACTGCCGGTTCCGTGGCCGACCCTGGTGACCACCCTGACCTATGGCGTTCAGTGCTTTAGCCGC

TATCCGGATCATATGAAACAGCATGATTTCTTTAAAAGCGCGATGCCGGAAGGCTATGTGCAGGAACGTACCATTTT

TTTCAAAGATGATGGCAACTATAAAACCCGTGCGGAAGTTAAATTTGAAGGCGATACCCTGGTGAACCGCATTGAAC

TGAAAGGTATTGATTTTAAAGAAGATGGCAACATTCTGGGTCATAAACTGGAATATAATTACAACAGCCATAATGTG

TATATTATGGCCGATAAACAGAAAAATGGCATCAAAGTGAACTTTAAAATCCGTCACAACATTGAAGATGGTAGCGT

GCAGCTGGCGGATCATTATCAGCAGAATACCCCGATTGGTGATGGCCCGGTGCTGCTGCCGGATAATCATTATCTGA

GCACCCAGAGCGCGCTGAGCAAAGATCCGAATGAAAACGTGATCATATGGTGCTGCTGGAATTTGTTACCGCCGCG

GGCATTACCCTGGGTATGGATGAACTGTATAAA (LbCas12a(E795L)-APAPAPAPA-eGFP chimera DNA sequence)

SEQ ID NO: 398

ATGAGCAAACTGGAAAAGTTCACCAACTGTTATAGCCTGAGCAAAACCCTGCGTTTTAAAGCAATTCCGGTTGGTAA

AACCCAAGAGAACATTGATAATAAACGCCTGCTGGTCGAAGATGAAAAACGCGCTGAAGATTATAAAGGCGTGAAAA

-continued

```
AACTGCTGGATCGCTATTATCTGAGCTTCATTAACGATGTGCTGCACAGCATTAAACTGAAGAACCTGAACAACTAT
ATCAGCCTGTTTCGTAAAAAAACCCGCACCGAAAAAGAAAACAAAGAGCTGGAAAACCTGGAAATCAATCTGCGTAA
AGAAATCGCCAAAGCGTTTAAAGGTAACGAGGGTTATAAAAGCCTGTTCAAGAAAGACATCATCGAAACCATTCTGC
CGGAATTTCTGGATGATAAAGATGAAATTGCCCTGGTGAATAGCTTTAATGGCTTTACCACCGCATTTACCGGCTTT
TTTGATAATCGCGAAAACATGTTCAGCGAAGAAGCAAAAAGCACCAGCATTGCATTTCGCTGCATTAATGAAAATCT
GACCCGCTACATTAGCAACATGGATATCTTTGAAAAAGTGGACGCGATCTTCGATAAACACGAAGTGCAAGAGATCA
AAGAGAAAATCCTGAACAGCGATTATGACGTCGAAGATTTTTTTGAAGGCGAGTTCTTTAACTTCGTTCTGACCCAA
GAAGGTATCGACGTTTATAACGCAATTATTGGTGGTTTTGTTACCGAAAGCGGTGAGAAAATCAAAGGCCTGAATGA
ATATATCAACCTGTATAACCAGAAAACCAAACAGAAACTGCCGAAATTCAAACCGCTGTATAAACAGGTTCTGAGCG
ATCGTGAAAGCCTGAGCTTTTATGGTGAAGGTTATACCAGTGATGAAGAGGTTCTGGAAGTTTTTCGTAACACCCTG
AATAAAAACAGCGAGATCTTTAGCAGCATCAAAAAGCTTGAGAAACTGTTCAAAAACTTTGATGAGTATAGCAGCGC
AGGCATCTTTGTTAAAAATGGTCCGGCAATTAGCACCATCAGCAAAGATATTTTTGGCAATGGAATGTGATCCGCG
ATAAATGGAATGCCGAATATGATGATATCCACCTGAAAAAAAAGGCCGTGGTGACCGAGAAATATGAAGATGATCGT
CGTAAAAGCTTCAAGAAAATTGGTAGCTTTAGCCTGGAACAGCTGCAAGAATATGCAGATGCAGATCTGAGCGTTGT
GGAAAAACTGAAAGAAATCATCATTCAGAAGGTGGACGAGATCTATAAAGTTTATGGTAGCAGCGAAAAACTGTTCG
ATGCAGATTTTGTTCTGGAAAAAAGCCTGAAAAAGAATGATGCCGTTGTGGCCATTATGAAAGATCTGCTGGATAGC
GTTAAGAGCTTCGAGAATTACATCAAAGCCTTTTTTGGTGAGGGCAAAGAAACCAATCGTGATGAAAGTTTCTATGG
CGATTTTGTGCTGGCCTATGATATTCTGCTGAAAGTGGACCATATTTATGATGCCATTCGCAATTATGTTACCCAGA
AACCGTATAGCAAAGACAAGTTCAAACTGTACTTTCAGAACCCGCAGTTTATGGGTGGTTGGGATAAAGATAAAGAA
ACCGATTATCGTGCCACCATCCTGCGTTATGGTAGTAAATACTATCTGGCCATCATGGACAAAAAATACGCAAAATG
CCTGCAGAAAATCGACAAAGATGATGTGAATGGCAACTATGAAAAAATCAACTACAAACTGCTGCCTGGTCCGAATA
AAATGCTGCCGAAAGTGTTCTTTAGCAAGAAATGGATGCCTATTATAACCCGAGCGAGGATATTCAAAAGATCTAC
AAAAATGGCACCTTTAAAAAGGGCGACATGTTCAATCTGAACGATTGCCACAAACTGATCGATTTCTTCAAAGATTC
AATTTCGCGTTATCCGAAATGGTCCAATGCCTATGATTTTAACTTTAGCGAAACCGAAAAATACAAAGACATTGCCG
GTTTTTATCGCGAAGTGGAAGAACAGGGCTATAAAGTGAGCTTTGAAAGCGCAAGCAAAAAAGAGGTTGATAAGCTG
GTTGAAGAGGGCAAACTGTATATGTTCCAGATTTACAACAAAGATTTTAGCGACAAAAGCCATGGCACCCCGAATCT
GCATACCATGTACTTTAAACTGCTGTTCGACGAAAATAACCATGGTCAGATTCGTCTGAGCGGTGGTGCCGAACTGT
TTATGCGTCGTGCAAGTCTGAAAAAAGAAGAACTGGTTGTTCATCCGGCAAATAGCCCGATTGCAAACAAAATCCG
GACAATCCGAAAAAACCACGACACTGAGCTATGATGTGTATAAAGACAAACGTTTTAGCGAGGATCAGTATCTGCT
GCATATCCCGATTGCCATCAATAAATGCCCGAAAAACATCTTTAAGATCAACACCGAAGTTCGCGTGCTGCTGAAAC
ATGATGATAATCCGTATGTGATTGGCATTGATCGTGGTGAACGTAACCTGCTGTATATTGTTGTTGTTGATGGTAAA
GGCAACATCGTGGAACAGTATAGTCTGAACGAAATTATCAACAACTTTAACGGCATCCGCATCAAAACCGACTATCA
TAGCCTGCTGGACAAGAAAGAAAAGAACGTTTTGAAGCACGTCAGAACTGGACCAGTATTGAAAACATCAAAGAAC
TGAAAGCCGGTTATATTAGCCAGGTGGTTCATAAAATCTGTGAGCTGGTAGAAAAATACGATGCAGTTATTGCACTG
GAAGATCTGAATAGCGGTTTCAAAAATAGCCGTGTGAAAGTCGAAAAACAGGTGTATCAGAATTCGAGAAATGCT
GATCGACAAACTGAACTACATGGTCGACAAAAAAGCAATCCGTGTGCAACCGGTGGTGCACTGAAAGGTTATCAGA
TTACCAACAAATTTGAAAGCTTTAAAAGCATGAGCACCCAGAACGGCTTTATCTTCTATATTCCGGCATGGCTGACC
AGCAAAATTGATCCGAGCACCGGTTTTGTGAACCTGCTGAAAACAAAATATACCTCCATTGCCGACAGCAAGAAGTT
TATTAGCAGCTTTGATCGCATTATGTATGTTCCGGAAGAGGACCTGTTTGAATTCGCACTGGATTACAAAAATTTCA
GCCGTACCGATGCCGACTACATCAAAAAATGGAAACTGTACAGCTATGGTAACCGCATTCGCATTTTTCGCAACCCG
AAGAAAAACAATGTGTTCGATTGGGAAGAAGTTTGTCTGACCAGCGCATATAAAGAACTTTTCAACAAATACGGCAT
```

-continued

```
CAACTATCAGCAGGGTGATATTCGTGCACTGCTGTGTGAACAGAGCGATAAAGCGTTTTATAGCAGTTTTATGGCAC
TGATGAGCCTGATGCTGCAGATGCGTAATAGCATTACCGGTCGCACCGATGTGGATTTTCTGATTAGTCCGGTGAAA
AATTCCGATGGCATCTTTTATGATAGCCGCAATTACGAAGCACAAGAAAATGCAATTCTGCCGAAAAACGCAGATGC
AAATGGTGCATATAACATTGCACGTAAAGTTCTGTGGGCAATTGGCCAGTTTAAGAAAGCAGAAGATGAGAAGCTGG
ACAAAGTGAAAATTGCGATCAGCAATAAAGAGTGGCTGGAATACGCACAGACCAGCGTTAAACATGCTCCTGCGCCA
GCTCCTGCACCTGCGATGGTTAGCAAAGGTGAAGAACTGTTTACCGGCGTTGTGCCGATTCTGGTGGAACTGGATGG
TGATGTGAATGGCCATAAATTTAGCGTTAGCGGCGAAGGCGAAGGTGATGCGACCTATGGTAAACTGACCCTGAAAT
TTATTTGCACCACCGGTAAACTGCCGGTTCCGTGGCCGACCCTGGTGACCACCCTGACCTATGGCGTTCAGTGCTTT
AGCCGCTATCCGGATCATATGAAACAGCATGATTTCTTTAAAAGCGCGATGCCGGAAGGCTATGTGCAGGAACGTAC
CATTTTTTTCAAAGATGATGGCAACTATAAAACCCGTGCGGAAGTTAAATTTGAAGGCGATACCCTGGTGAACCGCA
TTGAACTGAAAGGTATTGATTTTAAAGAAGATGGCAACATTCTGGGTCATAAACTGGAATATAATTACAACAGCCAT
AATGTGTATATTATGGCCGATAAACAGAAAAATGGCATCAAAGTGAACTTTAAAATCCGTCACAACATTGAAGATGG
TAGCGTGCAGCTGGCGGATCATTATCAGCAGAATACCCCGATTGGTGATGGCCCGGTGCTGCTGCCGGATAATCATT
ATCTGAGCACCCAGAGCGCGCTGAGCAAAGATCCGAATGAAAAACGTGATCATATGGTGCTGCTGGAATTTGTTACC
GCCGCGGGCATTACCCTGGGTATGGATGAACTGTATAAA
(LbCas12a (E795L)-APAPAPAPAPA-eGFP chimera DNA sequence)
                                                                SEQ ID NO: 399
ATGAGCAAACTGGAAAAGTTCACCAACTGTTATAGCCTGAGCAAAACCCTGCGTTTTAAAGCAATTCCGGTTGGTAA
AACCCAAGAGAACATTGATAATAAACGCCTGCTGGTCGAAGATGAAAAACGCGCTGAAGATTATAAAGGCGTGAAAA
AACTGCTGGATCGCTATTATCTGAGCTTCATTAACGATGTGCTGCACAGCATTAAACTGAAGAACCTGAACAACTAT
ATCAGCCTGTTTCGTAAAAAAACCCGCACCGAAAAGAAAACAAAGAGCTGGAAAACCTGGAAATCAATCTGCGTAA
AGAAATCGCCAAAGCGTTTAAAGGTAACGAGGGTTATAAAAGCCTGTTCAAGAAAGACATCATCGAAACCATTCTGC
CGGAATTTCTGGATGATAAAGATGAAATTGCCCTGGTGAATAGCTTTAATGGCTTTACCACCGCATTTACCGGCTTT
TTTGATAATCGCGAAAACATGTTCAGCGAAGAAGCAAAAAGCACCAGCATTGCATTTCGCTGCATTAATGAAAATCT
GACCCGCTACATTAGCAACATGGATATCTTTGAAAAAGTGGACGCGATCTTCGATAAACACGAAGTGCAAGAGATCA
AAGAGAAAATCCTGAACAGCGATTATGACGTCGAAGATTTTTTTGAAGGCGAGTTCTTTAACTTCGTTCTGACCCAA
GAAGGTATCGACGTTTATAACGCAATTATTGGTGGTTTTGTTACCGAAAGCGGTGAGAAAATCAAAGGCCTGAATGA
ATATATCAACCTGTATAACCAGAAAACCAAACAGAAACTGCCGAAATTCAAACCGCTGTATAAACAGGTTCTGAGCG
ATCGTGAAAGCCTGAGCTTTTATGGTGAAGGTTATACCAGTGATGAAGAGGTTCTGGAAGTTTTTCGTAACACCCTG
AATAAAAACAGCGAGATCTTTAGCAGCATCAAAAAGCTTGAGAAACTGTTCAAAAACTTTGATGAGTATAGCAGCGC
AGGCATCTTTGTTAAAAATGGTCCGGCAATTAGCACCATCAGCAAAGATATTTTTGGCGAATGGAATGTGATCCGCG
ATAAATGGAATGCCGAATATGATGATATCCACCTGAAAAAAAAGGCCGTGGTGACCGAGAAATATGAAGATGATCGT
CGTAAAAGCTTCAAGAAAATTGGTAGCTTTAGCCTGGAACAGCTGCAAGAATATGCAGATGCAGATCTGAGCGTTGT
GGAAAAACTGAAAGAAATCATCATTCAGAAGGTGGACGAGATCTATAAAGTTTATGGTAGCAGCGAAAAACTGTTCG
ATGCAGATTTTGTTCTGGAAAAAAGCCTGAAAAAGAATGATGCCGTTGTGGCCATTATGAAAGATCTGCTGGATAGC
GTTAAGAGCTTCGAGAATTACATCAAAGCCTTTTTTGGTGAGGGCAAAGAAACCAATCGTGATGAAAGTTTCTATGG
CGATTTTGTGCTGGCCTATGATATTCTGCTGAAAGTGGACCATATTTATGATGCCATTCGCAATTATGTTACCCAGA
AACCGTATAGCAAAGACAAGTTCAAACTGTACTTTCAGAACCCGCAGTTTATGGGTGGTTGGGATAAAGATAAGGAA
ACCGATTATCGTGCCACCATCCTGCGTTATGGTAGTAAATACTATCTGGCCATCATGGACAAAAAATACGCAAAATG
CCTGCAGAAAATCGACAAAGATGATGTGAATGGCAACTATGAAAAAATCAACTACAAACTGCTGCCTGGTCCGAATA
AAATGCTGCCGAAAGTGTTCTTTAGCAAGAAATGGATGGCCTATTATAACCCGAGCGAGGATATTCAAAAGATCTAC
```

-continued

```
AAAAATGGCACCTTTAAAAAGGGCGACATGTTCAATCTGAACGATTGCCACAAACTGATCGATTTCTTCAAAGATTC

AATTTCGCGTTATCCGAAATGGTCCAATGCCTATGATTTTAACTTTAGCGAAACCGAAAAATACAAAGACATTGCCG

GTTTTTATCGCGAAGTGGAAGAACAGGGCTATAAAGTGAGCTTTGAAAGCGCAAGCAAAAAGAGGTTGATAAGCTG

GTTGAAGAGGGCAAACTGTATATGTTCCAGATTTACAACAAAGATTTTAGCGACAAAAGCCATGGCACCCCGAATCT

GCATACCATGTACTTTAAACTGCTGTTCGACGAAAATAACCATGGTCAGATTCGTCTGAGCGGTGGTGCCGAACTGT

TTATGCGTCGTGCAAGTCTGAAAAAAGAAGAACTGGTTGTTCATCCGGCAAATAGCCCGATTGCAAACAAAAATCCG

GACAATCCGAAAAAAACCACGACACTGAGCTATGATGTGTATAAAGACAAACGTTTTAGCGAGGATCAGTATCTGCT

GCATATCCCGATTGCCATCAATAAATGCCCGAAAAACATCTTTAAGATCAACACCGAAGTTCGCGTGCTGCTGAAAC

ATGATGATAATCCGTATGTGATTGGCATTGATCGTGGTGAACGTAACCTGCTGTATATTGTTGTTGTTGATGGTAAA

GGCAACATCGTGGAACAGTATAGTCTGAACGAAATTATCAACAACTTTAACGGCATCCGCATCAAAACCGACTATCA

TAGCCTGCTGGACAAGAAAGAAAAAGAACGTTTTGAAGCACGTCAGAACTGGACCAGTATTGAAAACATCAAAGAAC

TGAAAGCCGGTTATATTAGCCAGGTGGTTCATAAAATCTGTGAGCTGGTAGAAAAATACGATGCAGTTATTGCACTG

GAAGATCTGAATAGCGGTTTCAAAAATAGCCGTGTGAAAGTCGAAAAACAGGTGTATCAGAAATTCGAGAAAATGCT

GATCGACAAACTGAACTACATGGTCGACAAAAAAGCAATCCGTGTGCAACCGGTGGTGCACTGAAAGGTTATCAGA

TTACCAACAAATTTGAAAGCTTTAAAAGCATGAGCACCCAGAACGGCTTTATCTTCTATATTCCGGCATGGCTGACC

AGCAAAATTGATCCGAGCACCGGTTTTGTGAACCTGCTGAAAACAAAATATACCTCCATTGCCGACAGCAAGAAGTT

TATTAGCAGCTTTGATCGCATTATGTATGTTCCGGAAGAGGACCTGTTTGAATTCGCACTGGATTACAAAAATTTCA

GCCGTACCGATGCCGACTACATCAAAAAATGGAAACTGTACAGCTATGGTAACCGCATTCGCATTTTTCGCAACCCG

AAGAAAAACAATGTGTTCGATTGGGAAGAAGTTTGTCTGACCAGCGCATATAAAGAACTTTTCAACAAATACGGCAT

CAACTATCAGCAGGGTGATATTCGTGCACTGCTGTGTGAACAGAGCGATAAAGCGTTTTATAGCAGTTTTATGGCAC

TGATGAGCCTGATGCTGCAGATGCGTAATAGCATTACCGGTCGCACCGATGTGGATTTTCTGATTAGTCCGGTGAAA

AATTCCGATGGCATCTTTTATGATAGCCGCAATTACGAAGCACAAGAAAATGCAATTCTGCCGAAAAACGCAGATGC

AAATGGTGCATATAACATTGCACGTAAAGTTCTGTGGGCAATTGGCCAGTTTAAGAAAGCAGAAGATGAGAAGCTGG

ACAAAGTGAAAATTGCGATCAGCAATAAAGAGTGGCTGGAATACGCACAGACCAGCGTTAAACATGCGCCCGCTCCT

GCGCCAGCTCCTGCACCTGCGATGGTTAGCAAAGGTGAAGAACTGTTTACCGGCGTTGTGCCGATTCTGGTGGAACT

GGATGGTGATGTGAATGGCCATAAATTTAGCGTTAGCGGCGAAGGCGAAGGTGATGCGACCTATGGTAAACTGACCC

TGAAATTTATTTGCACCACCGGTAAACTGCCGGTTCCGTGGCCGACCCTGGTGACCACCCTGACCTATGGCGTTCAG

TGCTTTAGCCGCTATCCGGATCATATGAAACAGCATGATTTCTTTAAAAGCGCGATGCCGGAAGGCTATGTGCAGGA

ACGTACCATTTTTTTCAAAGATGATGGCAACTATAAAACCCGTGCGGAAGTTAAATTTGAAGGCGATACCCTGGTGA

ACCGCATTGAACTGAAAGGTATTGATTTTAAAGAAGATGGCAACATTCTGGGTCATAAACTGGAATATAATTACAAC

AGCCATAATGTGTATATTATGGCCGATAAACAGAAAAATGGCATCAAAGTGAACTTTAAAATCCGTCACAACATTGA

AGATGGTAGCGTGCAGCTGGCGGATCATTATCAGCAGAATACCCCGATTGGTGATGGCCCGGTGCTGCTGCCGGATA

ATCATTATCTGAGCACCCAGAGCGCGCTGAGCAAAGATCCGAATGAAAAACGTGATCATATGGTGCTGCTGGAATTT

GTTACCGCCGCGGGCATTACCCTGGGTATGGATGAACTGTATAAA
```

(LbCas12a (E795L)-APAPAPAPAPAPA-eGFP chimera DNA sequence)

SEQ ID NO: 400

```
ATGAGCAAACTGGAAAAGTTCACCAACTGTTATAGCCTGAGCAAAACCCTGCGTTTTAAAGCAATTCCGGTTGGTAA

AACCCAAGAGAACATTGATAATAAACGCCTGCTGGTCGAAGATGAAAAACGCGCTGAAGATTATAAAGGCGTGAAAA

AACTGCTGGATCGCTATTATCTGAGCTTCATTAACGATGTGCTGCACAGCATTAAACTGAAGAACCTGAACAACTAT

ATCAGCCTGTTTCGTAAAAAAACCCGCACCGAAAAGAAAACAAAGAGCTGGAAAACCTGGAAATCAATCTGCGTAA

AGAAATCGCCAAAGCGTTTAAAGGTAACGAGGGTTATAAAAGCCTGTTCAAGAAAGACATCATCGAAACCATTCTGC

CGGAATTTCTGGATGATAAAGATGAAATTGCCCTGGTGAATAGCTTTAATGGCTTTACCACCGCATTTACCGGCTTT
```

-continued

```
TTTGATAATCGCGAAAACATGTTCAGCGAAGAAGCAAAAAGCACCAGCATTGCATTTCGCTGCATTAATGAAAATCT
GACCCGCTACATTAGCAACATGGATATCTTTGAAAAAGTGGACGCGATCTTCGATAAACACGAAGTGCAAGAGATCA
AAGAGAAAATCCTGAACAGCGATTATGACGTCGAAGATTTTTTTGAAGGCGAGTTCTTTAACTTCGTTCTGACCCAA
GAAGGTATCGACGTTTATAACGCAATTATTGGTGGTTTTGTTACCGAAAGCGGTGAGAAAATCAAAGGCCTGAATGA
ATATATCAACCTGTATAACCAGAAAACCAAACAGAAACTGCCGAAATTCAAACCGCTGTATAAACAGGTTCTGAGCG
ATCGTGAAAGCCTGAGCTTTTATGGTGAAGGTTATACCAGTGATGAAGAGGTTCTGGAAGTTTTTCGTAACACCCTG
AATAAAAACAGCGAGATCTTTAGCAGCATCAAAAAGCTTGAGAAACTGTTCAAAAACTTTGATGAGTATAGCAGCGC
AGGCATCTTTGTTAAAAATGGTCCGGCAATTAGCACCATCAGCAAAGATATTTTTGGCGAATGGAATGTGATCCGCG
ATAAATGGAATGCCGAATATGATGATATCCACCTGAAAAAAAGGCCGTGGTGACCGAGAAATATGAAGATGATCGT
CGTAAAAGCTTCAAGAAAATTGGTAGCTTTAGCCTGGAACAGCTGCAAGAATATGCAGATGCAGATCTGAGCGTTGT
GGAAAAACTGAAAGAAATCATCATTCAGAAGGTGGACGAGATCTATAAAGTTTATGGTAGCAGCGAAAAACTGTTCG
ATGCAGATTTTGTTCTGGAAAAAAGCCTGAAAAAGAATGATGCCGTTGTGGCCATTATGAAAGATCTGCTGGATAGC
GTTAAGAGCTTCGAGAATTACATCAAAGCCTTTTTTGGTGAGGGCAAAGAAACCAATCGTGATGAAAGTTTCTATGG
CGATTTTGTGCTGGCCTATGATATTCTGCTGAAAGTGGACCATATTTATGATGCCATTCGCAATTATGTTACCCAGA
AACCGTATAGCAAAGACAAGTTCAAACTGTACTTTCAGAACCCGCAGTTTATGGGTGGTTGGGATAAAGATAAAGAA
ACCGATTATCGTGCCACCATCCTGCGTTATGGTAGTAAATACTATCTGGCCATCATGGACAAAAAATACGCAAAATG
CCTGCAGAAAATCGACAAAGATGATGTGAATGGCAACTATGAAAAAATCAACTACAAACTGCTGCCTGGTCCGAATA
AAATGCTGCCGAAAGTGTTCTTTAGCAAGAAATGGATGGCCTATTATAACCCGAGCGAGGATATTCAAAAGATCTAC
AAAAATGGCACCTTTAAAAAGGGCGACATGTTCAATCTGAACGATTGCCACAAACTGATCGATTTCTTCAAAGATTC
AATTTCGCGTTATCCGAAATGGTCCAATGCCTATGATTTTAACTTTAGCGAAACCGAAAAATACAAAGACATTGCCG
GTTTTTATCGCGAAGTGGAAGAACAGGGCTATAAAGTGAGCTTTGAAAGCGCAAGCAAAAAAGAGGTTGATAAGCTG
GTTGAAGAGGGCAAACTGTATATGTTCCAGATTTACAACAAAGATTTTAGCGACAAAAGCCATGGCACCCCGAATCT
GCATACCATGTACTTTAAACTGCTGTTCGACGAAAATAACCATGGTCAGATTCGTCTGAGCGGTGGTGCCGAACTGT
TTATGCGTCGTGCAAGTCTGAAAAAAGAAGAACTGGTTGTTCATCCGGCAAATAGCCCGATTGCAAACAAAAATCCG
GACAATCCGAAAAAAACCACGACACTGAGCTATGATGTGTATAAAGACAAACGTTTTAGCGAGGATCAGTATCTGCT
GCATATCCCGATTGCCATCAATAAATGCCCGAAAAACATCTTTAAGATCAACACCGAAGTTCGCGTGCTGCTGAAAC
ATGATGATAATCCGTATGTGATTGGCATTGATCGTGGTGAACGTAACCTGCTGTATATTGTTGTTGATGGTAAA
GGCAACATCGTGGAACAGTATAGTCTGAACGAAATTATCAACAACTTTAACGGCATCCGCATCAAAACCGACTATCA
TAGCCTGCTGGACAAGAAAGAAAAAGAACGTTTTGAAGCACGTCAGAACTGGACCAGTATTGAAAACATCAAAGAAC
TGAAAGCCGGTTATATTAGCCAGGTGGTTCATAAAATCTGTGAGCTGGTAGAAAAATACGATGCAGTTATTGCACTG
GAAGATCTGAATAGCGGTTTCAAAAATAGCCGTGTGAAAGTCGAAAAACAGGTGTATCAGAAATTCGAGAAAATGCT
GATCGACAAACTGAACTACATGGTCGACAAAAAAAGCAATCCGTGTGCAACCGGTGGTGCACTGAAAGGTTATCAGA
TTACCAACAAATTTGAAAGCTTTAAAAGCATGAGCACCCAGAACGGCTTTATCTTCTATATTCCGGCATGGCTGACC
AGCAAAATTGATCCGAGCACCGGTTTTGTGAACCTGCTGAAAACAAAATATACCTCCATTGCCGACAGCAAGAAGTT
TATTAGCAGCTTTGATCGCATTATGTATGTTCCGGAAGAGGACCTGTTTGAATTCGCACTGGATTACAAAAATTTCA
GCCGTACCGATGCCGACTACATCAAAAAATGGAAACTGTACAGCTATGGTAACCGCATTCGCATTTTTCGCAACCCG
AAGAAAAACAATGTGTTCGATTGGGAAGAAGTTTGTCTGACCAGCGCATATAAAGAACTTTTCAACAATACGGCAT
CAACTATCAGCAGGGTGATATTCGTGCACTGCTGTGTGAACAGAGCGATAAAGCGTTTTATAGCAGTTTTATGGCAC
TGATGAGCCTGATGCTGCAGATGCGTAATAGCATTACCGGTCGCACCGATGTGGATTTTCTGATTAGTCCGGTGAAA
AATTCCGATGGCATCTTTTATGATAGCCGCAATTACGAAGCACAAGAAAATGCAATTCTGCCGAAAAACGCAGATGC
```

-continued

AAATGGTGCATATAACATTGCACGTAAAGTTCTGTGGGCAATTGGCCAGTTTAAGAAAGCAGAAGATGAGAAGCTGG

ACAAAGTGAAAATTGCGATCAGCAATAAAGAGTGGCTGGAATACGCACAGACCAGCGTTAAACATGCGCCAGCGCCT

GCTCCTGCACCCGCTCCAGCACCTGCGATGGTTAGCAAAGGTGAAGAACTGTTTACCGGCGTTGTGCCGATTCTGGT

GGAACTGGATGGTGATGTGAATGGCCATAAATTTAGCGTTAGCGGCGAAGGCGAAGGTGATGCGACCTATGGTAAAC

TGACCCTGAAATTTATTTGCACCACCGGTAAACTGCCGGTTCCGTGGCCGACCCTGGTGACCACCCTGACCTATGGC

GTTCAGTGCTTTAGCCGCTATCCGGATCATATGAAACAGCATGATTTCTTTAAAAGCGCGATGCCGGAAGGCTATGT

GCAGGAACGTACCATTTTTTTCAAAGATGATGGCAACTATAAAACCCGTGCGGAAGTTAAATTTGAAGGCGATACCC

TGGTGAACCGCATTGAACTGAAAGGTATTGATTTTAAAGAAGATGGCAACATTCTGGGTCATAAACTGGAATATAAT

TACAACAGCCATAATGTGTATATTATGGCCGATAAACAGAAAATGGCATCAAAGTGAACTTTAAAATCCGTCACAA

CATTGAAGATGGTAGCGTGCAGCTGGCGGATCATTATCAGCAGAATACCCCGATTGGTGATGGCCCGGTGCTGCTGC

CGGATAATCATTATCTGAGCACCCAGAGCGCGCTGAGCAAAGATCCGAATGAAAACGTGATCATATGGTGCTGCTG

GAATTTGTTACCGCCGCGGGCATTACCCTGGGTATGGATGAACTGTATAAA (LbCas12a (E795L)-APAPAPAPAPAPAPAPA-eGFP chimera DNA sequence)

SEQ ID NO: 401

ATGAGCAAACTGGAAAAGTTCACCAACTGTTATAGCCTGAGCAAAACCCTGCGTTTTAAAGCAATTCCGGTTGGTAA

AACCCAAGAGAACATTGATAATAAACGCCTGCTGGTCGAAGATGAAAAACGCGCTGAAGATTATAAAGGCGTGAAAA

AACTGCTGGATCGCTATTATCTGAGCTTCATTAACGATGTGCTGCACAGCATTAAACTGAAGAACCTGAACAACTAT

ATCAGCCTGTTTCGTAAAAAAACCCGCACCGAAAAAGAAAACAAAGAGCTGGAAAACCTGGAAATCAATCTGCGTAA

AGAAATCGCCAAAGCGTTTAAAGGTAACGAGGGTTATAAAAGCCTGTTCAAGAAAGACATCATCGAAACCATTCTGC

CGGAATTTCTGGATGATAAAGATGAAATTGCCCTGGTGAATAGCTTTAATGGCTTTACCACCGCATTTACCGGCTTT

TTTGATAATCGCGAAAACATGTTCAGCGAAGAAGCAAAAAGCACCAGCATTGCATTTCGCTGCATTAATGAAAATCT

GACCCGCTACATTAGCAACATGGATATCTTTGAAAAAGTGGACGCGATCTTCGATAAACACGAAGTGCAAGAGATCA

AAGAGAAAATCCTGAACAGCGATTATGACGTCGAAGATTTTTTTGAAGGCGAGTTCTTTAACTTCGTTCTGACCCAA

GAAGGTATCGACGTTTATAACGCAATTATTGGTGGTTTTGTTACCGAAAGCGGTGAGAAAATCAAAGGCCTGAATGA

ATATATCAACCTGTATAACCAGAAAACCAAACAGAAACTGCCGAAATTCAAACCGCTGTATAAACAGGTTCTGAGCG

ATCGTGAAAGCCTGAGCTTTTATGGTGAAGGTTATACCAGTGATGAAGAGGTTCTGGAAGTTTTTCGTAACACCCTG

AATAAAAACAGCGAGATCTTTAGCAGCATCAAAAAGCTTGAGAAACTGTTCAAAAACTTTGATGAGTATAGCAGCGC

AGGCATCTTTGTTAAAAATGGTCCGGCAATTAGCACCATCAGCAAAGATATTTTTGGCGAATGGAATGTGATCCGCG

ATAAATGGAATGCCGAATATGATGATATCCACCTGAAAAAAAAGGCCGTGGTGACCGAGAAATATGAAGATGATCGT

CGTAAAAGCTTCAAGAAAATTGGTAGCTTTAGCCTGGAACAGCTGCAAGAATATGCAGATGCAGATCTGAGCGTTGT

GGAAAAAACTGAAAGAAATCATCATTCAGAAGGTGGACGAGATCTATAAAGTTTATGGTAGCAGCGAAAAACTGTTCG

ATGCAGATTTTGTTCTGGAAAAAAGCCTGAAAAAGAATGATGCCGTTGTGGCCATTATGAAGATCTGCTGGATAGC

GTTAAGAGCTTCGAGAATTACATCAAAGCCTTTTTTGGTGAGGGCAAAGAAACCAATCGTGATGAAAGTTTCTATGG

CGATTTTGTGCTGGCCTATGATATTCTGCTGAAAGTGGACCATATTTATGATGCCATTCGCAATTATGTTACCCAGA

AACCGTATAGCAAAGACAAGTTCAAACTGTACTTTCAGAACCCGCAGTTTATGGGTGGTTGGGATAAAGATAAGAA

ACCGATTATCGTGCCACCATCCTGCGTTATGGTAGTAAATACTATCTGGCCATCATGGACAAAAATACGCAAAATG

CCTGCAGAAAATCGACAAAGATGATGTGAATGGCAACTATGAAAAAATCAACTACAAACTGCTGCCTGGTCCGAATA

AAATGCTGCCGAAAGTGTTCTTTAGCAAGAAATGGATGGCCTATTATAACCCGAGCGAGGATATTCAAAAGATCTAC

AAAAATGGCACCTTTAAAAAGGGCGACATGTTCAATCTGAACGATTGCCACAAACTGATCGATTTCTTCAAAGATTC

AATTTCGCGTTATCCGAAATGGTCCAATGCCTATGATTTTAACTTTAGCGAAACCGAAAAATACAAAGACATTGCCG

GTTTTTATCGCGAAGTGGAAGAACAGGGCTATAAAGTGAGCTTTGAAAGCGCAAGCAAAAAGAGGTTGATAAGCTG

GTTGAAGAGGGCAAACTGTATATGTTCCAGATTTACAACAAAGATTTTAGCGACAAAAGCCATGGCACCCCCGAATCT

-continued

```
GCATACCATGTACTTTAAACTGCTGTTCGACGAAAATAACCATGGTCAGATTCGTCTGAGCGGTGGTGCCGAACTGT
TTATGCGTCGTGCAAGTCTGAAAAAAGAAGAACTGGTTGTTCATCCGGCAAATAGCCCGATTGCAAACAAAAATCCG
GACAATCCGAAAAAAACCACGACACTGAGCTATGATGTGTATAAAGACAAACGTTTTAGCGAGGATCAGTATCTGCT
GCATATCCCGATTGCCATCAATAAATGCCCGAAAAACATCTTTAAGATCAACACCGAAGTTCGCGTGCTGCTGAAAC
ATGATGATAATCCGTATGTGATTGGCATTGATCGTGGTGAACGTAACCTGCTGTATATTGTTGTTGTTGATGGTAAA
GGCAACATCGTGGAACAGTATAGTCTGAACGAAATTATCAACAACTTTAACGGCATCCGCATCAAAACCGACTATCA
TAGCCTGCTGGACAAGAAAGAAAAAGAACGTTTTGAAGCACGTCAGAACTGGACCAGTATTGAAAACATCAAAGAAC
TGAAAGCCGGTTATATTAGCCAGGTGGTTCATAAAATCTGTGAGCTGGTAGAAAAATACGATGCAGTTATTGCACTG
GAAGATCTGAATAGCGGTTTCAAAAATAGCCGTGTGAAAGTCGAAAAACAGGTGTATCAGAAATTCGAGAAAATGCT
GATCGACAAACTGAACTACATGGTCGACAAAAAAAGCAATCCGTGTGCAACCGGTGGTGCACTGAAAGGTTATCAGA
TTACCAACAAATTTGAAAGCTTTAAAAGCATGAGCACCCAGAACGGCTTTATCTTCTATATTCCGGCATGGCTGACC
AGCAAAATTGATCCGAGCACCGGTTTTGTGAACCTGCTGAAAACAAAATATACCTCCATTGCCGACAGCAAGAAGTT
TATTAGCAGCTTTGATCGCATTATGTATGTTCCGGAAGAGGACCTGTTTGAATTCGCACTGGATTACAAAAATTTCA
GCCGTACCGATGCCGACTACATCAAAAAATGGAAACTGTACAGCTATGGTAACCGCATTCGCATTTTTCGCAACCCG
AAGAAAAACAATGTGTTCGATTGGGAAGAAGTTTGTCTGACCAGCGCATATAAAGAACTTTTCAACAAATACGGCAT
CAACTATCAGCAGGGTGATATTCGTGCACTGCTGTGTGAACAGAGCGATAAAGCGTTTTATAGCAGTTTTATGGCAC
TGATGAGCCTGATGCTGCAGATGCGTAATAGCATTACCGGTCGCACCGATGTGGATTTTCTGATTAGTCCGGTGAAA
AATTCCGATGGCATCTTTTATGATAGCCGCAATTACGAAGCACAAGAAAATGCAATTCTGCCGAAAAACGCAGATGC
AAATGGTGCATATAACATTGCACGTAAAGTTCTGTGGGCAATTGGCCAGTTTAAGAAAGCAGAAGATGAGAAGCTGG
ACAAAGTGAAAATTGCGATCAGCAATAAAGAGTGGCTGGAATACGCACAGACCAGCGTTAAACATGCGCCAGCGCCT
GCTCCTGCACCCGCTCCAGCTCCTGCCCCAGCGATGGTTAGCAAAGGTGAAGAACTGTTTACCGGCGTTGTGCCGAT
TCTGGTGGAACTGGATGGTGATGTGAATGGCCATAAATTTAGCGTTAGCGGCGAAGGCGAAGGTGATGCGACCTATG
GTAAACTGACCCTGAAATTTATTTGCACCACCGGTAAACTGCCGGTTCCGTGGCCGACCCTGGTGACCACCCTGACC
TATGGCGTTCAGTGCTTTAGCCGCTATCCGGATCATATGAAACAGCATGATTTCTTTAAAAGCGCGATGCCGGAAGG
CTATGTGCAGGAACGTACCATTTTTTTTCAAAGATGATGGCAACTATAAAACCCGTGCGGAAGTTAAATTTGAAGGCG
ATACCCTGGTGAACCGCATTGAACTGAAAGGTATTGATTTTAAAGAAGATGGCAACATTCTGGGTCATAAACTGGAA
TATAATTACAACAGCCATAATGTGTATATTATGGCCGATAAACAGAAAAATGGCATCAAAGTGAACTTTAAAATCCG
TCACAACATTGAAGATGGTAGCGTGCAGCTGGCGGATCATTATCAGCAGAATACCCCGATTGGTGATGGCCCGGTGC
TGCTGCCGGATAATCATTATCTGAGCACCCAGAGCGCGCTGAGCAAAGATCCGAATGAAAAACGTGATCATATGGTG
CTGCTGGAATTTGTTACCGCCGCGGGCATTACCCTGGGTATGGATGAACTGTATAAA
```

(LbCas12a (E795L)-APAPAPAPAPAPAPAPAPA-eGFP chimera DNA sequence)

SEQ ID NO: 402

```
ATGAGCAAACTGGAAAAGTTCACCAACTGTTATAGCCTGAGCAAAACCCTGCGTTTTAAAGCAATTCCGGTTGGTAA
AACCCAAGAGAACATTGATAATAAACGCCTGCTGGTCGAAGATGAAAAACGCGCTGAAGATTATAAAGGCGTGAAAA
AACTGCTGGATCGCTATTATCTGAGCTTCATTAACGATGTGCTGCACAGCATTAAACTGAAGAACCTGAACAACTAT
ATCAGCCTGTTTCGTAAAAAAACCCGCACCGAAAAAGAAAACAAAGAGCTGGAAAACCTGGAAATCAATCTGCGTAA
AGAAATCGCCAAAGCGTTTAAAGGTAACGAGGGTTATAAAAGCCTGTTCAAGAAAGACATCATCGAAACCATTCTGC
CGGAATTTCTGGATGATAAAGATGAAATTGCCCTGGTGAATAGCTTTAATGGCTTTACCACCGCATTTACCGGCTTT
TTTGATAATCGCGAAAACATGTTCAGCGAAGAAGCAAAAAGCACCAGCATTGCATTTCGCTGCATTAATGAAAATCT
GACCCGCTACATTAGCAACATGGATATCTTTGAAAAAGTGGACGCGATCTTCGATAAACACGAAGTGCAAGAGATCA
AAGAGAAAATCCTGAACAGCGATTATGACGTCGAAGATTTTTTTGAAGGCGAGTTCTTTAACTTCGTTCTGACCCAA
```

-continued

```
GAAGGTATCGACGTTTATAACGCAATTATTGGTGGTTTTGTTACCGAAAGCGGTGAGAAAATCAAAGGCCTGAATGA
ATATATCAACCTGTATAACCAGAAAACCAAACAGAAACTGCCGAAATTCAAACCGCTGTATAAACAGGTTCTGAGCG
ATCGTGAAAGCCTGAGCTTTTATGGTGAAGGTTATACCAGTGATGAAGAGGTTCTGGAAGTTTTTCGTAACACCCTG
AATAAAAACAGCGAGATCTTTAGCAGCATCAAAAAGCTTGAGAAACTGTTCAAAAACTTTGATGAGTATAGCAGCGC
AGGCATCTTTGTTAAAAATGGTCCGGCAATTAGCACCATCAGCAAAGATATTTTTGGCGAATGGAATGTGATCCGCG
ATAAATGGAATGCCGAATATGATGATATCCACCTGAAAAAAAGGCCGTGGTGACCGAGAAATATGAAGATGATCGT
CGTAAAAGCTTCAAGAAAATTGGTAGCTTTAGCCTGGAACAGCTGCAAGAATATGCAGATGCAGATCTGAGCGTTGT
GGAAAAACTGAAAGAAATCATCATTCAGAAGGTGGACGAGATCTATAAAGTTTATGGTAGCAGCGAAAAACTGTTCG
ATGCAGATTTTGTTCTGGAAAAAAGCCTGAAAAAGAATGATGCCGTTGTGGCCATTATGAAAGATCTGCTGGATAGC
GTTAAGAGCTTCGAGAATTACATCAAAGCCTTTTTTGGTGAGGGCAAAGAAACCAATCGTGATGAAAGTTTCTATGG
CGATTTTGTGCTGGCCTATGATATTCTGCTGAAAGTGGACCATATTTATGATGCCATTCGCAATTATGTTACCCAGA
AACCGTATAGCAAAGACAAGTTCAAACTGTACTTTCAGAACCCGCAGTTTATGGGTGGTTGGGATAAAGATAAAGAA
ACCGATTATCGTGCCACCATCCTGCGTTATGGTAGTAAATACTATCTGGCCATCATGGACAAAAAATACGCAAAATG
CCTGCAGAAAATCGACAAAGATGATGTGAATGGCAACTATGAAAAAATCAACTACAAACTGCTGCCTGGTCCGAATA
AAATGCTGCCGAAAGTGTTCTTTAGCAAGAAATGGATGGCCTATTATAACCCGAGCGAGGATATTCAAAAGATCTAC
AAAAATGGCACCTTTAAAAAGGGCGACATGTTCAATCTGAACGATTGCCACAAACTGATCGATTTCTTCAAAGATTC
AATTTCGCGTTATCCGAAATGGTCCAATGCCTATGATTTTAACTTTAGCGAAACCGAAAAATACAAAGACATTGCCG
GTTTTTATCGCGAAGTGGAAGAACAGGGCTATAAAGTGAGCTTTGAAAGCGCAAGCAAAAAAGAGGTTGATAAGCTG
GTTGAAGAGGGCAAACTGTATATGTTCCAGATTTACAACAAAGATTTTAGCGACAAAAGCCATGGCACCCCGAATCT
GCATACCATGTACTTTAAACTGCTGTTCGACGAAAATAACCATGGTCAGATTCGTCTGAGCGGTGGTGCCGAACTGT
TTATGCGTCGTGCAAGTCTGAAAAAAGAAGAACTGGTTGTTCATCCGGCAAATAGCCCGATTGCAAACAAAAATCCG
GACAATCCGAAAAAAACCACGACACTGAGCTATGATGTGTATAAAGACAAACGTTTTAGCGAGGATCAGTATCTGCT
GCATATCCCGATTGCCATCAATAAATGCCCGAAAAACATCTTTAAGATCAACACCGAAGTTCGCGTGCTGCTGAAAC
ATGATGATAATCCGTATGTGATTGGCATTGATCGTGGTGAACGTAACCTGCTGTATATTGTTGTTGTTGATGGTAAA
GGCAACATCGTGGAACAGTATAGTCTGAACGAAATTATCAACAACTTTAACGGCATCCGCATCAAAACCGACTATCA
TAGCCTGCTGGACAAGAAGAAAAAGAACGTTTTGAAGCACGTCAGAACTGGACCAGTATTGAAAACATCAAAGAAC
TGAAAGCCGGTTATATTAGCCAGGTGGTTCATAAAATCTGTGAGCTGGTAGAAAAATACGATGCAGTTATTGCACTG
GAAGATCTGAATAGCGGTTTCAAAAATAGCCGTGTGAAAGTCGAAAAACAGGTGTATCAGAAATTCGAGAAAATGCT
GATCGACAAACTGAACTACATGGTCGACAAAAAAAGCAATCCGTGTGCAACCGGTGGTGCACTGAAAGGTTATCAGA
TTACCAACAAATTTGAAAGCTTTAAAAGCATGAGCACCCAGAACGGCTTTATCTTCTATATTCCGGCATGGCTGACC
AGCAAAATTGATCCGAGCACCGGTTTTGTGAACCTGCTGAAAACAAAATATACCTCCATTGCCGACAGCAAGAAGTT
TATTAGCAGCTTTGATCGCATTATGTATGTTCCGGAAGAGGACCTGTTTGAATTCGCACTGGATTACAAAAATTTCA
GCCGTACCGATGCCGACTACATCAAAAAATGGAAACTGTACAGCTATGGTAACCGCATTCGCATTTTTCGCAACCCG
AAGAAAAACAATGTGTTCGATTGGGAAGAAGTTTGTCTGACCAGCGCATATAAAGAACTTTTCAACAAATACGGCAT
CAACTATCAGCAGGGTGATATTCGTGCACTGCTGTGTGAACAGAGCGATAAAGCGTTTTATAGCAGTTTTATGGCAC
TGATGAGCCTGATGCTGCAGATGCGTAATAGCATTACCGGTCGCACCGATGTGGATTTTCTGATTAGTCCGGTGAAA
AATTCCGATGGCATCTTTTATGATAGCCGCAATTACGAAGCACAAGAAATGCAATTCTGCCGAAAAACGCAGATGC
AAATGGTGCATATAACATTGCACGTAAAGTTCTGTGGGCAATTGGCCAGTTTAAGAAAGCAGAAGATGAGAAGCTGG
ACAAAGTGAAAATTGCGATCAGCAATAAAGAGTGGCTGGAATACGCACAGACCAGCGTTAAACATGCGCCAGCGCCT
GCTCCTGCACCCGCTCCAGCGCCAGCTCCTGCACCTGCGATGGTTAGCAAAGGTGAAGAACTGTTTACCGGCGTTGT
GCCGATTCTGGTGGAACTGGATGGTGATGTGAATGGCCATAAATTTAGCGTTAGCGGCGAAGGCGAAGGTGATGCGA
```

```
CCTATGGTAAACTGACCCTGAAATTTATTTGCACCACCGGTAAACTGCCGGTTCCGTGGCCGACCCTGGTGACCACC
CTGACCTATGGCGTTCAGTGCTTTAGCCGCTATCCGGATCATATGAAACAGCATGATTTCTTTAAAAGCGCGATGCC
GGAAGGCTATGTGCAGGAACGTACCATTTTTTTCAAAGATGATGGCAACTATAAAACCCGTGCGGAAGTTAAATTTG
AAGGCGATACCCTGGTGAACCGCATTGAACTGAAAGGTATTGATTTTAAAGAAGATGGCAACATTCTGGGTCATAAA
CTGGAATATAATTACAACAGCCATAATGTGTATATTATGGCCGATAAACAGAAAAATGGCATCAAAGTGAACTTTAA
AATCCGTCACAACATTGAAGATGGTAGCGTGCAGCTGGCGGATCATTATCAGCAGAATACCCCGATTGGTGATGGCC
CGGTGCTGCTGCCGGATAATCATTATCTGAGCACCCAGAGCGCGCTGAGCAAAGATCCGAATGAAAACGTGATCAT
ATGGTGCTGCTGGAATTTGTTACCGCCGCGGGCATTACCCTGGGTATGGATGAACTGTATAAA
```

(LbCas12a (E795L)-APAPAPAPAPAPAPAPAPA-eGFP chimera DNA sequence)

SEQ ID NO: 403

```
ATGAGCAAACTGGAAAAGTTCACCAACTGTTATAGCCTGAGCAAAACCCTGCGTTTTAAAGCAATTCCGGTTGGTAA
AACCCAAGAGAACATTGATAATAAACGCCTGCTGGTCGAAGATGAAAAACGCGCTGAAGATTATAAAGGCGTGAAAA
AACTGCTGGATCGCTATTATCTGAGCTTCATTAACGATGTGCTGCACAGCATTAAACTGAAGAACCTGAACAACTAT
ATCAGCCTGTTTCGTAAAAAAACCCGCACCGAAAAAGAAAACAAAGAGCTGGAAAACCTGGAAATCAATCTGCGTAA
AGAAATCGCCAAAGCGTTTAAAGGTAACGAGGGTTATAAAAGCCTGTTCAAGAAAGACATCATCGAAACCATTCTGC
CGGAATTTCTGGATGATAAAGATGAAATTGCCCTGGTGAATAGCTTTAATGGCTTTACCACCGCATTTACCGGCTTT
TTTGATAATCGCGAAAACATGTTCAGCGAAGAAGCAAAAAGCACCAGCATTGCATTTCGCTGCATTAATGAAAATCT
GACCCGCTACATTAGCAACATGGATATCTTTGAAAAAGTGGACGCGATCTTCGATAAACACGAAGTGCAAGAGATCA
AAGAGAAAATCCTGAACAGCGATTATGACGTCGAAGATTTTTTTGAAGGCGAGTTCTTTAACTTCGTTCTGACCCAA
GAAGGTATCGACGTTTATAACGCAATTATTGGTGGTTTTGTTACCGAAAGCGGTGAGAAAATCAAAGGCCTGAATGA
ATATATCAACCTGTATAACCAGAAAACCAAACAGAAACTGCCGAAATTCAAACCGCTGTATAAACAGGTTCTGAGCG
ATCGTGAAAGCCTGAGCTTTTATGGTGAAGGTTATACCAGTGATGAAGAGGTTCTGGAAGTTTTTCGTAACACCCTG
AATAAAAACAGCGAGATCTTTAGCAGCATCAAAAAGCTTGAGAAACTGTTCAAAAACTTTGATGAGTATAGCAGCGC
AGGCATCTTTGTTAAAAATGGTCCGGCAATTAGCACCATCAGCAAAGATATTTTTGGCGAATGGAATGTGATCCGCG
ATAAATGGAATGCCGAATATGATGATATCCACCTGAAAAAAAAGGCCGTGGTGACCGAGAAATATGAAGATGATCGT
CGTAAAAGCTTCAAGAAAATTGGTAGCTTTAGCCTGGAACAGCTGCAAGAATATGCAGATGCAGATCTGAGCGTTGT
GGAAAAACTGAAAGAAATCATCATTCAGAAGGTGGACGAGATCTATAAAGTTTATGGTAGCAGCGAAAAACTGTTCG
ATGCAGATTTTGTTCTGGAAAAAAGCCTGAAAAAGAATGATGCCGTTGTGGCCATTATGAAAGATCTGCTGGATAGC
GTTAAGAGCTTCGAGAATTACATCAAAGCCTTTTTTGGTGAGGGCAAAGAAACCAATCGTGATGAAAGTTTCTATGG
CGATTTTGTGCTGGCCTATGATATTCTGCTGAAAGTGGACCATATTTATGATGCCATTCGCAATTATGTTACCCAGA
AACCGTATAGCAAAGACAAGTTCAAACTGTACTTTCAGAACCCGCAGTTTATGGGTGGTTGGGATAAAGATAAAGAA
ACCGATTATCGTGCCACCATCCTGCGTTATGGTAGTAAATACTATCTGGCCATCATGGACAAAAAATACGCAAAATG
CCTGCAGAAAATCGACAAAGATGATGTGAATGGCAACTATGAAAAAATCAACTACAAACTGCTGCCTGGTCCGAATA
AAATGCTGCCGAAAGTGTTCTTTAGCAAGAAATGGATGGCCTATTATAACCCGAGCGAGGATATTCAAAAGATCTAC
AAAAATGGCACCTTTAAAAAGGGCGACATGTTCAATCTGAACGATTGCCACAAACTGATCGATTTCTTCAAAGATTC
AATTTCGCGTTATCCGAAATGGTCCAATGCCTATGATTTTAACTTTAGCGAAACCGAAAAATACAAAGACATTGCCG
GTTTTTATCGCGAAGTGGAAGAACAGGGCTATAAAGTGAGCTTTGAAAGCGCAAGCAAAAAGAGGTTGATAAGCTG
GTTGAAGAGGGCAAACTGTATATGTTCCAGATTTACAACAAAGATTTTAGCGACAAAAGCCATGGCACCCCGAATCT
GCATACCATGTACTTTAAACTGCTGTTCGACGAAAATAACCATGGTCAGATTCGTCTGAGCGGTGGTGCCGAACTGT
TTATGCGTCGTGCAAGTCTGAAAAAAGAAGAACTGGTTGTTCATCCGGCAAATAGCCCCGATTGCAAACAAAAATCCG
GACAATCCGAAAAAAACCACGACACTGAGCTATGATGTGTATAAAGACAAACGTTTTAGCGAGGATCAGTATCTGCT
```

-continued

```
GCATATCCCGATTGCCATCAATAAATGCCCGAAAAACATCTTTAAGATCAACACCGAAGTTCGCGTGCTGCTGAAAC

ATGATGATAATCCGTATGTGATTGGCATTGATCGTGGTAACGTAACCTGCTGTATATTGTTGTTGTTGATGGTAAA

GGCAACATCGTGGAACAGTATAGTCTGAACGAAATTATCAACAACTTTAACGGCATCCGCATCAAAACCGACTATCA

TAGCCTGCTGGACAAGAAAGAAAAAGAACGTTTTGAAGCACGTCAGAACTGGACCAGTATTGAAAACATCAAAGAAC

TGAAAGCCGGTTATATTAGCCAGGTGGTTCATAAAATCTGTGAGCTGGTAGAAAAATACGATGCAGTTATTGCACTG

GAAGATCTGAATAGCGGTTTCAAAAATAGCCGTGTGAAAGTCGAAAAACAGGTGTATCAGAAATTCGAGAAAATGCT

GATCGACAAACTGAACTACATGGTCGACAAAAAAAGCAATCCGTGTGCAACCGGTGGTGCACTGAAAGGTTATCAGA

TTACCAACAAATTTGAAAGCTTTAAAAGCATGAGCACCCAGAACGGCTTTATCTTCTATATTCCGGCATGGCTGACC

AGCAAAATTGATCCGAGCACCGGTTTTGTGAACCTGCTGAAAACAAAATATACCTCCATTGCCGACAGCAAGAAGTT

TATTAGCAGCTTTGATCGCATTATGTATGTTCCGGAAGAGGACCTGTTTGAATTCGCACTGGATTACAAAAATTTCA

GCCGTACCGATGCCGACTACATCAAAAAATGGAAACTGTACAGCTATGGTAACCGCATTCGCATTTTTCGCAACCCG

AAGAAAAACAATGTGTTCGATTGGGAAGAAGTTTGTCTGACCAGCGCATATAAAGAACTTTTCAACAAATACGGCAT

CAACTATCAGCAGGGTGATATTCGTGCACTGCTGTGTGAACAGAGCGATAAAGCGTTTTATAGCAGTTTTATGGCAC

TGATGAGCCTGATGCTGCAGATGCGTAATAGCATTACCGGTCGCACCGATGTGGATTTTCTGATTAGTCCGGTGAAA

AATTCCGATGGCATCTTTTATGATAGCCGCAATTACGAAGCACAAGAAAATGCAATTCTGCCGAAAAACGCAGATGC

AAATGGTGCATATAACATTGCACGTAAAGTTCTGTGGGCAATTGGCCAGTTTAAGAAAGCAGAAGATGAGAAGCTGG

ACAAAGTGAAAATTGCGATCAGCAATAAAGAGTGGCTGGAATACGCACAGACCAGCGTTAAACATGCGCCAGCGCCT

GCTCCTGCACCCGCTCCAGCTCCTGCGCCAGCTCCTGCACCTGCGATGGTTAGCAAAGGTGAAGAACTGTTTACCGG

CGTTGTGCCGATTCTGGTGGAACTGGATGGTGATGTGAATGGCCATAAATTTAGCGTTAGCGGCGAAGGCGAAGGTG

ATGCGACCTATGGTAAACTGACCCTGAAATTTATTTGCACCACCGGTAAACTGCCGGTTCCGTGGCCGACCCTGGTG

ACCACCCTGACCTATGGCGTTCAGTGCTTTAGCCGCTATCCGGATCATATGAAACAGCATGATTTCTTTAAAAGCGC

GATGCCGGAAGGCTATGTGCAGGAACGTACCATTTTTTTCAAAGATGATGGCAACTATAAAACCCGTGCGGAAGTTA

AATTTGAAGGCGATACCCTGGTGAACCGCATTGAACTGAAAGGTATTGATTTTAAAGAAGATGGCAACATTCTGGGT

CATAAACTGGAATATAATTACAACAGCCATAATGTGTATATTATGGCCGATAAACAGAAAAATGGCATCAAAGTGAA

CTTTAAAATCCGTCACAACATTGAAGATGGTAGCGTGCAGCTGGCGGATCATTATCAGCAGAATACCCCGATTGGTG

ATGGCCCGGTGCTGCTGCCGGATAATCATTATCTGAGCACCCAGAGCGCGCTGAGCAAAGATCCGAATGAAAAACGT

GATCATATGGTGCTGCTGGAATTTGTTACCGCCGCGGGCATTACCCTGGGTATGGATGAACTGTATAAA (LbCas12a (E795L)-APAPAPAPAPAPAPAPAPAPAPA-eGFP chimera DNA sequence)
                                                          SEQ ID NO: 404
ATGAGCAAACTGGAAAAGTTCACCAACTGTTATAGCCTGAGCAAAACCCTGCGTTTTAAAGCAATTCCGGTTGGTAA

AACCCAAGAGAACATTGATAATAAACGCCTGCTGGTCGAAGATGAAAAACGCGCTGAAGATTATAAAGGCGTGAAAA

AACTGCTGGATCGCTATTATCTGAGCTTCATTAACGATGTGCTGCACAGCATTAAACTGAAGAACCTGAACAACTAT

ATCAGCCTGTTTCGTAAAAAAACCCGCACCGAAAAAGAAAACAAAGAGCTGGAAAACCTGGAAATCAATCTGCGTAA

AGAAATCGCCAAAGCGTTTAAAGGTAACGAGGGTTATAAAAGCCTGTTCAAGAAAGACATCATCGAAACCATTCTGC

CGGAATTTCTGGATGATAAAGATGAAATTGCCCTGGTGAATAGCTTTAATGGCTTTACCACCGCATTTACCGGCTTT

TTTGATAATCGCGAAAACATGTTCAGCGAAGAAGCAAAAAGCACCAGCATTGCATTTCGCTGCATTAATGAAAATCT

GACCCGCTACATTAGCAACATGGATATCTTTGAAAAAGTGGACGCGATCTTCGATAAACACGAAGTGCAAGAGATCA

AAGAGAAAATCCTGAACAGCGATTATGACGTCGAAGATTTTTTTGAAGGCGAGTTCTTTAACTTCGTTCTGACCCAA

GAAGGTATCGACGTTTATAACGCAATTATTGGTGGTTTTGTTACCGAAAGCGGTGAGAAAATCAAAGGCCTGAATGA

ATATATCAACCTGTATAACCAGAAAACCAAACAGAAACTGCCGAAATTCAAACCGCTGTATAAACAGGTTCTGAGCG

ATCGTGAAAGCCTGAGCTTTTATGGTGAAGGTTATACCAGTGATGAAGAGGTTCTGGAAGTTTTTCGTAACACCCTG

AATAAAAACAGCGAGATCTTTAGCAGCATCAAAAAGCTTGAGAAACTGTTCAAAAACTTTGATGAGTATAGCAGCGC
```

```
AGGCATCTTTGTTAAAAATGGTCCGGCAATTAGCACCATCAGCAAAGATATTTTTGGCGAATGGAATGTGATCCGCG

ATAAATGGAATGCCGAATATGATGATATCCACCTGAAAAAAAAGGCCGTGGTGACCGAGAAATATGAAGATGATCGT

CGTAAAAGCTTCAAGAAAATTGGTAGCTTTAGCCTGGAACAGCTGCAAGAATATGCAGATGCAGATCTGAGCGTTGT

GGAAAAACTGAAAGAAATCATCATTCAGAAGGTGGACGAGATCTATAAAGTTTATGGTAGCAGCGAAAAACTGTTCG

ATGCAGATTTTGTTCTGGAAAAAAGCCTGAAAAAGAATGATGCCGTTGTGGCCATTATGAAAGATCTGCTGGATAGC

GTTAAGAGCTTCGAGAATTACATCAAAGCCTTTTTTGGTGAGGGCAAAGAAACCAATCGTGATGAAAGTTTCTATGG

CGATTTTGTGCTGGCCTATGATATTCTGCTGAAAGTGGACCATATTTATGATGCCATTCGCAATTATGTTACCCAGA

AACCGTATAGCAAAGACAAGTTCAAACTGTACTTTCAGAACCCGCAGTTTATGGGTGGTTGGGATAAAGATAAAGAA

ACCGATTATCGTGCCACCATCCTGCGTTATGGTAGTAAATACTATCTGGCCATCATGGACAAAAAATACGCAAAATG

CCTGCAGAAAATCGACAAAGATGATGTGAATGGCAACTATGAAAAATCAACTACAAACTGCTGCCTGGTCCGAATA

AAATGCTGCCGAAAGTGTTCTTTAGCAAGAAATGGATGGCCTATTATAACCCGAGCGAGGATATTCAAAGATCTAC

AAAAATGGCACCTTTAAAAAGGGCGACATGTTCAATCTGAACGATTGCCACAAACTGATCGATTTCTTCAAAGATTC

AATTTCGCGTTATCCGAAATGGTCCAATGCCTATGATTTTAACTTTAGCGAAACCGAAAAATACAAAGACATTGCCG

GTTTTTATCGCGAAGTGGAAGAACAGGGCTATAAAGTGAGCTTTGAAAGCGCAAGCAAAAAAGAGGTTGATAAGCTG

GTTGAAGAGGGCAAACTGTATATGTTCCAGATTTACAACAAAGATTTTAGCGACAAAAGCCATGGCACCCCGAATCT

GCATACCATGTACTTTAAACTGCTGTTCGACGAAAATAACCATGGTCAGATTCGTCTGAGCGGTGGTGCCGAACTGT

TTATGCGTCGTGCAAGTCTGAAAAAAGAAGAACTGGTTGTTCATCCGGCAAATAGCCCGATTGCAAACAAAAATCCG

GACAATCCGAAAAAAACCACGACACTGAGCTATGATGTGTATAAAGACAAACGTTTTAGCGAGGATCAGTATCTGCT

GCATATCCCGATTGCCATCAATAAATGCCCGAAAAACATCTTTAAGATCAACACCGAAGTTCGCGTGCTGCTGAAAC

ATGATGATAATCCGTATGTGATTGGCATTGATCGTGGTGAACGTAACCTGCTGTATATTGTTGTTGTTGATGGTAAA

GGCAACATCGTGGAACAGTATAGTCTGAACGAAATTATCAACAACTTTAACGGCATCCGCATCAAAACCGACTATCA

TAGCCTGCTGGACAAGAAAGAAAAAGAACGTTTTGAAGCACGTCAGAACTGGACCAGTATTGAAAACATCAAAGAAC

TGAAAGCCGGTTATATTAGCCAGGTGGTTCATAAAATCTGTGAGCTGGTAGAAAAATACGATGCAGTTATTGCACTG

GAAGATCTGAATAGCGGTTTCAAAAATAGCCGTGTGAAAGTCGAAAAACAGGTGTATCAGAAATTCGAGAAAATGCT

GATCGACAAACTGAACTACATGGTCGACAAAAAAAGCAATCCGTGTGCAACCGGTGGTGCACTGAAAGGTTATCAGA

TTACCAACAAATTTGAAAGCTTTAAAAGCATGAGCACCCAGAACGGCTTATCTTCTATATTCCGGCATGGCTGACC

AGCAAAATTGATCCGAGCACCGGTTTTGTGAACCTGCTGAAAACAAAATATACCTCCATTGCCGACAGCAAGAAGTT

TATTAGCAGCTTTGATCGCATTATGTATGTTCCGGAAGAGGACCTGTTTGAATTCGCACTGGATTACAAAAATTTCA

GCCGTACCGATGCCGACTACATCAAAAAATGGAAACTGTACAGCTATGGTAACCGCATTCGCATTTTTCGCAACCCG

AAGAAAAACAATGTGTTCGATTGGGAAGAAGTTTGTCTGACCAGCGCATATAAAGAACTTTTCAACAAATACGGCAT

CAACTATCAGCAGGGTGATATTCGTGCACTGCTGTGTGAACAGAGCGATAAAGCGTTTTATAGCAGTTTTATGGCAC

TGATGAGCCTGATGCTGCAGATGCGTAATAGCATTACCGGTCGCACCGATGTGGATTTTCTGATTAGTCCGGTGAAA

AATTCCGATGGCATCTTTTATGATAGCCGCAATTACGAAGCACAAGAAATGCAATTCTGCCGAAAAACGCAGATGC

AAATGGTGCATATAACATTGCACGTAAAGTTCTGTGGGCAATTGGCCAGTTTAAGAAAGCAGAAGATGAGAAGCTGG

ACAAAGTGAAAATTGCGATCAGCAATAAAGAGTGGCTGGAATACGCACAGACCAGCGTTAAACATGCGCCAGCGCCT

GCTCCTGCACCCGCTCCAGCTCCTGCTCCTGCGCCAGCTCCTGCACCTGCGATGGTTAGCAAAGGTGAAGAACTGTT

TACCGGCGTTGTGCCGATTCTGGTGGAACTGGATGGTGATGTGAATGGCCATAAATTTAGCGTTAGCGGCGAAGGCG

AAGGTGATGCGACCTATGGTAAACTGACCCTGAAATTTATTTGCACCACCGGTAAACTGCCGGTTCCGTGGCCGACC

CTGGTGACCACCCTGACCTATGGCGTTCAGTGCTTTAGCCGCTATCCGGATCATATGAAACAGCATGATTTCTTTAA

AAGCGCGATGCCGGAAGGCTATGTGCAGGAACGTACCATTTTTTTCAAAGATGATGGCAACTATAAAACCCGTGCGG
```

-continued

AAGTTAAATTTGAAGGCGATACCCTGGTGAACCGCATTGAACTGAAAGGTATTGATTTTAAAGAAGATGGCAACATT

CTGGGTCATAAACTGGAATATAATTACAACAGCCATAATGTGTATATTATGGCCGATAAACAGAAAAATGGCATCAA

AGTGAACTTTAAAATCCGTCACAACATTGAAGATGGTAGCGTGCAGCTGGCGGATCATTATCAGCAGAATACCCCGA

TTGGTGATGGCCCGGTGCTGCTGCCGGATAATCATTATCTGAGCACCCAGAGCGCGCTGAGCAAAGATCCGAATGAA

AAACGTGATCATATGGTGCTGCTGGAATTTGTTACCGCCGCGGGCATTACCCTGGGTATGGATGAACTGTATAAA (LbCas12a (E795L)-APAPAPAPAPAPAPAPAPAPAPAPA-eGFP chimera DNA sequence)
SEQ ID NO: 405

ATGAGCAAACTGGAAAAGTTCACCAACTGTTATAGCCTGAGCAAAACCCTGCGTTTTAAAGCAATTCCGGTTGGTAA

AACCCAAGAGAACATTGATAATAAACGCCTGCTGGTCGAAGATGAAAAACGCGCTGAAGATTATAAAGGCGTGAAAA

AACTGCTGGATCGCTATTATCTGAGCTTCATTAACGATGTGCTGCACAGCATTAAACTGAAGAACCTGAACAACTAT

ATCAGCCTGTTTCGTAAAAAAACCCGCACCGAAAAAGAAAACAAAGAGCTGGAAAACCTGGAAATCAATCTGCGTAA

AGAAATCGCCAAAGCGTTTAAAGGTAACGAGGGTTATAAAAGCCTGTTCAAGAAAGACATCATCGAAACCATTCTGC

CGGAATTTCTGGATGATAAAGATGAAATTGCCCTGGTGAATAGCTTTAATGGCTTTACCACCGCATTTACCGGCTTT

TTTGATAATCGCGAAAACATGTTCAGCGAAGAAGCAAAAAGCACCAGCATTGCATTTCGCTGCATTAATGAAAATCT

GACCCGCTACATTAGCAACATGGATATCTTTGAAAAAGTGGACGCGATCTTCGATAAACACGAAGTGCAAGAGATCA

AAGAGAAAATCCTGAACAGCGATTATGACGTCGAAGATTTTTTTGAAGGCGAGTTCTTTAACTTCGTTCTGACCCAA

GAAGGTATCGACGTTTATAACGCAATTATTGGTGGTTTTGTTACCGAAAGCGGTGAGAAAATCAAAGGCCTGAATGA

ATATATCAACCTGTATAACCAGAAAACCAAACAGAAACTGCCGAAATTCAAACCGCTGTATAAACAGGTTCTGAGCG

ATCGTGAAAGCCTGAGCTTTTATGGTGAAGGTTATACCAGTGATGAAGAGGTTCTGGAAGTTTTTCGTAACACCCTG

AATAAAAACAGCGAGATCTTTAGCAGCATCAAAAAGCTTGAGAAACTGTTCAAAAACTTTGATGAGTATAGCAGCGC

AGGCATCTTTGTTAAAAATGGTCCGGCAATTAGCACCATCAGCAAAGATATTTTTGGCGAATGGAATGTGATCCGCG

ATAAATGGAATGCCGAATATGATGATATCCACCTGAAAAAAAAGGCCGTGGTGACCGAGAAATATGAAGATGATCGT

CGTAAAAGCTTCAAGAAAATTGGTAGCTTTAGCCTGGAACAGCTGCAAGAATATGCAGATGCAGATCTGAGCGTTGT

GGAAAAACTGAAAGAAATCATCATTCAGAAGGTGGACGAGATCTATAAAGTTTATGGTAGCAGCGAAAAACTGTTCG

ATGCAGATTTTGTTCTGGAAAAAAGCCTGAAAAAGAATGATGCCGTTGTGGCCATTATGAAAGATCTGCTGGATAGC

GTTAAGAGCTTCGAGAATTACATCAAAGCCTTTTTTGGTGAGGGCAAAGAAACCAATCGTGATGAAAGTTTCTATGG

CGATTTTGTGCTGGCCTATGATATTCTGCTGAAAGTGGACCATATTTATGATGCCATTCGCAATTATGTTACCCAGA

AACCGTATAGCAAAGACAAGTTCAAACTGTACTTTCAGAACCCGCAGTTTATGGGTGGTTGGGATAAAGATAAAGAA

ACCGATTATCGTGCCACCATCCTGCGTTATGGTAGTAAATACTATCTGGCCATCATGGACAAAAAATACGCAAAATG

CCTGCAGAAAATCGACAAAGATGATGTGAATGGCAACTATGAAAAATCAACTACAAACTGCTGCCTGGTCCGAATA

AAATGCTGCCGAAAGTGTTCTTTAGCAAGAAATGGATGGCCTATTATAACCCGAGCGAGGATATTCAAAAGATCTAC

AAAAATGGCACCTTTAAAAAGGGCGACATGTTCAATCTGAACGATTGCCACAAACTGATCGATTTCTTCAAAGATTC

AATTTCGCGTTATCCGAAATGGTCCAATGCCTATGATTTTAACTTTAGCGAAACCGAAAAATACAAAGACATTGCCG

GTTTTTATCGCGAAGTGGAAGAACAGGGCTATAAAGTGAGCTTTGAAAGCGCAAGCAAAAAAGAGGTTGATAAGCTG

GTTGAAGAGGGCAAACTGTATATGTTCCAGATTTACAACAAAGATTTTAGCGACAAAAGCCATGGCACCCCGAATCT

GCATACCATGTACTTTAAACTGCTGTTCGACGAAAATAACCATGGTCAGATTCGTCTGAGCGGTGGTGCCGAACTGT

TTATGCGTCGTGCAAGTCTGAAAAAAGAAGAACTGGTTGTTCATCCGGCAAATAGCCCGATTGCAAACAAAAATCCG

GACAATCCGAAAAAAACCACGACACTGAGCTATGATGTGTATAAAGACAAACGTTTTAGCGAGGATCAGTATCTGCT

GCATATCCCGATTGCCATCAATAAATGCCCGAAAAACATCTTTAAGATCAACACCGAAGTTCGCGTGCTGCTGAAAC

ATGATGATAATCCGTATGTGATTGGCATTGATCGTGGTGAACGTAACCTGCTGTATATTGTTGTTGTTGATGGTAAA

GGCAACATCGTGGAACAGTATAGTCTGAACGAAATTATCAACAACTTTAACGGCATCCGCATCAAAACCGACTATCA

TAGCCTGCTGGACAAGAAAGAAAAAGAACGTTTTGAAGCACGTCAGAACTGGACCAGTATTGAAAACATCAAAGAAC

-continued

```
TGAAAGCCGGTTATATTAGCCAGGTGGTTCATAAAATCTGTGAGCTGGTAGAAAAATACGATGCAGTTATTGCACTG

GAAGATCTGAATAGCGGTTTCAAAAATAGCCGTGTGAAAGTCGAAAAACAGGTGTATCAGAAATTCGAGAAAATGCT

GATCGACAAACTGAACTACATGGTCGACAAAAAAAGCAATCCGTGTGCAACCGGTGGTGCACTGAAAGGTTATCAGA

TTACCAACAAATTTGAAAGCTTTAAAAGCATGAGCACCCAGAACGGCTTTATCTTCTATATTCCGGCATGGCTGACC

AGCAAAATTGATCCGAGCACCGGTTTTGTGAACCTGCTGAAAACAAAATATACCTCCATTGCCGACAGCAAGAAGTT

TATTAGCAGCTTTGATCGCATTATGTATGTTCCGGAAGAGGACCTGTTTGAATTCGCACTGGATTACAAAAATTTCA

GCCGTACCGATGCCGACTACATCAAAAAATGGAAACTGTACAGCTATGGTAACCGCATTCGCATTTTTCGCAACCCG

AAGAAAAACAATGTGTTCGATTGGGAAGAAGTTTGTCTGACCAGCGCATATAAAGAACTTTTCAACAAATACGGCAT

CAACTATCAGCAGGGTGATATTCGTGCACTGCTGTGTGAACAGAGCGATAAAGCGTTTTATAGCAGTTTTATGGCAC

TGATGAGCCTGATGCTGCAGATGCGTAATAGCATTACCGGTCGCACCGATGTGGATTTTCTGATTAGTCCGGTGAAA

AATTCCGATGGCATCTTTTATGATAGCCGCAATTACGAAGCACAAGAAATGCAATTCTGCCGAAAAACGCAGATGC

AAATGGTGCATATAACATTGCACGTAAAGTTCTGTGGGCAATTGGCCAGTTTAAGAAAGCAGAAGATGAGAAGCTGG

ACAAAGTGAAAATTGCGATCAGCAATAAAGAGTGGCTGGAATACGCACAGACCAGCGTTAAACATGCGCCAGCGCCT

GCTCCTGCACCCGCTCCAGCTCCTGCCCCAGCTCCAGCGCCCGCTCCTGCACCTGCGATGGTTAGCAAAGGTGAAGA

ACTGTTTACCGGCGTTGTGCCGATTCTGGTGGAACTGGATGGTGATGTGAATGGCCATAAATTTAGCGTTAGCGGCG

AAGGCGAAGGTGATGCGACCTATGGTAAACTGACCCTGAAATTTATTTGCACCACCGGTAAACTGCCGGTTCCGTGG

CCGACCCTGGTGACCACCCTGACCTATGGCGTTCAGTGCTTTAGCCGCTATCCGGATCATATGAAACAGCATGATTT

CTTTAAAAGCGCGATGCCGGAAGGCTATGTGCAGGAACGTACCATTTTTTTCAAAGATGATGGCAACTATAAAACCC

GTGCGGAAGTTAAATTTGAAGGCGATACCCTGGTGAACCGCATTGAACTGAAAGGTATTGATTTTAAAGAAGATGGC

AACATTCTGGGTCATAAACTGGAATATAATTACAACAGCCATAATGTGTATATTATGGCCGATAAACAGAAAAATGG

CATCAAAGTGAACTTTAAAATCCGTCACAACATTGAAGATGGTAGCGTGCAGCTGGCGGATCATTATCAGCAGAATA

CCCCGATTGGTGATGGCCCGGTGCTGCTGCCGGATAATCATTATCTGAGCACCCAGAGCGCGCTGAGCAAAGATCCG

AATGAAAAACGTGATCATATGGTGCTGCTGGAATTTGTTACCGCCGCGGGCATTACCCTGGGTATGGATGAACTGTA

TAAA (LbCas12a (E795L)-APAPAPAPAPAPAPAPAPAPAPAPAPA-eGFP chimera DNA sequence)
                                                            SEQ ID NO: 406
ATGAGCAAACTGGAAAAGTTCACCAACTGTTATAGCCTGAGCAAAACCCTGCGTTTTAAAGCAATTCCGGTTGGTAA

AACCCAAGAGAACATTGATAATAAACGCCTGCTGGTCGAAGATGAAAAACGCGCTGAAGATTATAAAGGCGTGAAAA

AACTGCTGGATCGCTATTATCTGAGCTTCATTAACGATGTGCTGCACAGCATTAAACTGAAGAACCTGAACAACTAT

ATCAGCCTGTTTCGTAAAAAAACCCGCACCGAAAAGAAAACAAAGAGCTGGAAAACCTGGAAATCAATCTGCGTAA

AGAAATCGCCAAAGCGTTTAAAGGTAACGAGGGTTATAAAAGCCTGTTCAAGAAAGACATCATCGAAACCATTCTGC

CGGAATTTCTGGATGATAAAGATGAAATTGCCCTGGTGAATAGCTTTAATGGCTTTACCACCGCATTTACCGGCTTT

TTTGATAATCGCGAAAACATGTTCAGCGAAGAAGCAAAAAGCACCAGCATTGCATTTCGCTGCATTAATGAAAATCT

GACCCGCTACATTAGCAACATGGATATCTTTGAAAAAGTGGACGCGATCTTCGATAAACACGAAGTGCAAGAGATCA

AAGAGAAAATCCTGAACAGCGATTATGACGTCGAAGATTTTTTTGAAGGCGAGTTCTTTAACTTCGTTCTGACCCAA

GAAGGTATCGACGTTTATAACGCAATTATTGGTGGTTTTGTTACCGAAAGCGGTGAGAAAATCAAAGGCCTGAATGA

ATATATCAACCTGTATAACCAGAAAACCAAACAGAAACTGCCGAAATTCAAACCGCTGTATAAACAGGTTCTGAGCG

ATCGTGAAAGCCTGAGCTTTTATGGTGAAGGTTATACCAGTGATGAAGAGGTTCTGGAAGTTTTTCGTAACACCCTG

AATAAAAACAGCGAGATCTTTAGCAGCATCAAAAAGCTTGAGAAACTGTTCAAAAACTTTGATGAGTATAGCAGCGC

AGGCATCTTTGTTAAAAATGGTCCGGCAATTAGCACCATCAGCAAAGATATTTTTGGCGAATGGAATGTGATCCGCG

ATAAATGGAATGCCGAATATGATGATATCCACCTGAAAAAAAAGGCCGTGGTGACCGAGAAATATGAAGATGATCGT
```

-continued
```
CGTAAAAGCTTCAAGAAAATTGGTAGCTTTAGCCTGGAACAGCTGCAAGAATATGCAGATGCAGATCTGAGCGTTGT

GGAAAAACTGAAAGAAATCATCATTCAGAAGGTGGACGAGATCTATAAAGTTTATGGTAGCAGCGAAAAACTGTTCG

ATGCAGATTTTGTTCTGGAAAAAAGCCTGAAAAAGAATGATGCCGTTGTGGCCATTATGAAAGATCTGCTGGATAGC

GTTAAGAGCTTCGAGAATTACATCAAAGCCTTTTTTGGTGAGGGCAAAGAAACCAATCGTGATGAAAGTTTCTATGG

CGATTTTGTGCTGGCCTATGATATTCTGCTGAAAGTGGACCATATTTATGATGCCATTCGCAATTATGTTACCCAGA

AACCGTATAGCAAAGACAAGTTCAAACTGTACTTTCAGAACCCGCAGTTTATGGGTGGTTGGGATAAAGATAAAGAA

ACCGATTATCGTGCCACCATCCTGCGTTATGGTAGTAAATACTATCTGGCCATCATGGACAAAAAATACGCAAAATG

CCTGCAGAAAATCGACAAAGATGATGTGAATGGCAACTATGAAAAAATCAACTACAAACTGCTGCCTGGTCCGAATA

AAATGCTGCCGAAAGTGTTCTTTAGCAAGAAATGGATGGCCTATTATAACCCGAGCGAGGATATTCAAAAGATCTAC

AAAAATGGCACCTTTAAAAAGGGCGACATGTTCAATCTGAACGATTGCCACAAACTGATCGATTTCTTCAAAGATTC

AATTTCGCGTTATCCGAAATGGTCCAATGCCTATGATTTTAACTTTAGCGAAACCGAAAAATACAAAGACATTGCCG

GTTTTTATCGCGAAGTGGAAGAACAGGGCTATAAAGTGAGCTTTGAAAGCGCAAGCAAAAAAGAGGTTGATAAGCTG

GTTGAAGAGGGCAAACTGTATATGTTCCAGATTTACAACAAAGATTTTAGCGACAAAAGCCATGGCACCCCGAATCT

GCATACCATGTACTTTAAACTGCTGTTCGACGAAAATAACCATGGTCAGATTCGTCTGAGCGGTGGTGCCGAACTGT

TTATGCGTCGTGCAAGTCTGAAAAAAGAAGAACTGGTTGTTCATCCGGCAAATAGCCCGATTGCAAACAAAAATCCG

GACAATCCGAAAAAAACCACGACACTGAGCTATGATGTGTATAAAGACAAACGTTTTAGCGAGGATCAGTATCTGCT

GCATATCCCGATTGCCATCAATAAATGCCCGAAAAACATCTTTAAGATCAACACCGAAGTTCGCGTGCTGCTGAAAC

ATGATGATAATCCGTATGTGATTGGCATTGATCGTGGTGAACGTAACCTGCTGTATATTGTTGTTGATGGTAAA

GGCAACATCGTGGAACAGTATAGTCTGAACGAAATTATCAACAACTTTAACGGCATCCGCATCAAAACCGACTATCA

TAGCCTGCTGGACAAGAAAGAAAAAGAACGTTTTGAAGCACGTCAGAACTGGACCAGTATTGAAAACATCAAAGAAC

TGAAAGCCGGTTATATTAGCCAGGTGGTTCATAAAATCTGTGAGCTGGTAGAAAAATACGATGCAGTTATTGCACTG

GAAGATCTGAATAGCGGTTTCAAAAATAGCCGTGTGAAAGTCGAAAAACAGGTGTATCAGAAATTCGAGAAAATGCT

GATCGACAAACTGAACTACATGGTCGACAAAAAAAGCAATCCGTGTGCAACCGGTGGTGCACTGAAAGGTTATCAGA

TTACCAACAAATTTGAAAGCTTTAAAAGCATGAGCACCCAGAACGGCTTTATCTTCTATATTCCGGCATGGCTGACC

AGCAAAATTGATCCGAGCACCGGTTTTGTGAACCTGCTGAAAACAAAATATACCTCCATTGCCGACAGCAAGAAGTT

TATTAGCAGCTTTGATCGCATTATGTATGTTCCGGAAGAGGACCTGTTTGAATTCGCACTGGATTACAAAAATTTCA

GCCGTACCGATGCCGACTACATCAAAAAATGGAAACTGTACAGCTATGGTAACCGCATTCGCATTTTTCGCAACCCG

AAGAAAAACAATGTGTTCGATTGGGAAGAAGTTTGTCTGACCAGCGCATATAAAGAACTTTTCAACAAATACGGCAT

CAACTATCAGCAGGGTGATATTCGTGCACTGCTGTGTGAACAGAGCGATAAAGCGTTTTATAGCAGTTTTATGGCAC

TGATGAGCCTGATGCTGCAGATGCGTAATAGCATTACCGGTCGCACCGATGTGGATTTTCTGATTAGTCCGGTGAAA

AATTCCGATGGCATCTTTTATGATAGCCGCAATTACGAAGCACAAGAAAATGCAATTCTGCCGAAAAACGCAGATGC

AAATGGTGCATATAACATTGCACGTAAAGTTCTGTGGGCAATTGGCCAGTTTAAGAAAGCAGAAGATGAGAAGCTGG

ACAAAGTGAAAATTGCGATCAGCAATAAAGAGTGGCTGGAATACGCACAGACCAGCGTTAAACATGCGCCAGCGCCT

GCTCCTGCACCCGCTCCAGCTCCTGCCCCAGCTCCAGCGCCCGCTCCTGCTCCTGCACCTGCGATGGTTAGCAAAGG

TGAAGAACTGTTTACCGGCGTTGTGCCGATTCTGGTGGAACTGGATGGTGATGTGAATGGCCATAAATTTAGCGTTA

GCGGCGAAGGCGAAGGTGATGCGACCTATGGTAAACTGACCCTGAAATTTATTTGCACCACCGGTAAACTGCCGGTT

CCGTGGCCGACCCTGGTGACCACCCTGACCTATGGCGTTCAGTGCTTTAGCCGCTATCCGGATCATATGAAACAGCA

TGATTTCTTTAAAAGCGCGATGCCGGAAGGCTATGTGCAGGAACGTACCATTTTTTTCAAAGATGATGGCAACTATA

AAACCCGTGCGGAAGTTAAATTTGAAGGCGATACCCTGGTGAACCGCATTGAACTGAAAGGTATTGATTTTAAAGAA

GATGGCAACATTCTGGGTCATAAACTGGAATATAATTACAACAGCCATAATGTGTATATTATGGCCGATAAACAGAA

AAATGGCATCAAAGTGAACTTTAAAATCCGTCACAACATTGAAGATGGTAGCGTGCAGCTGGCGGATCATTATCAGC
```

AGAATACCCCGATTGGTGATGGCCCGGTGCTGCTGCCGGATAATCATTATCTGAGCACCCAGAGCGCGCTGAGCAAA

GATCCGAATGAAAAACGTGATCATATGGTGCTGCTGGAATTTGTTACCGCCGCGGGCATTACCCTGGGTATGGATGA

ACTGTATAAA (LbCas12a (E795L)-APAPAPAPAPAPAPAPAPAPAPAPAPAPAPA-eGFP chimera DNA sequence)

SEQ ID NO: 407

ATGAGCAAACTGGAAAAGTTCACCAACTGTTATAGCCTGAGCAAAACCCTGCGTTTTAAAGCAATTCCGGTTGGTAA

AACCCAAGAGAACATTGATAATAAACGCCTGCTGGTCGAAGATGAAAAACGCGCTGAAGATTATAAAGGCGTGAAAA

AACTGCTGGATCGCTATTATCTGAGCTTCATTAACGATGTGCTGCACAGCATTAAACTGAAGAACCTGAACAACTAT

ATCAGCCTGTTTCGTAAAAAAACCCGCACCGAAAAAGAAAACAAAGAGCTGGAAAACCTGGAAATCAATCTGCGTAA

AGAAATCGCCAAAGCGTTTAAAGGTAACGAGGGTTATAAAAGCCTGTTCAAGAAAGACATCATCGAAACCATTCTGC

CGGAATTTCTGGATGATAAAGATGAAATTGCCCTGGTGAATAGCTTTAATGGCTTTACCACCGCATTTACCGGCTTT

TTTGATAATCGCGAAAACATGTTCAGCGAAGAAGCAAAAAGCACCAGCATTGCATTTCGCTGCATTAATGAAAATCT

GACCCGCTACATTAGCAACATGGATATCTTTGAAAAAGTGGACGCGATCTTCGATAAACACGAAGTGCAAGAGATCA

AAGAGAAAATCCTGAACAGCGATTATGACGTCGAAGATTTTTTTGAAGGCGAGTTCTTTAACTTCGTTCTGACCCAA

GAAGGTATCGACGTTTATAACGCAATTATTGGTGGTTTTGTTACCGAAAGCGGTGAGAAAATCAAAGGCCTGAATGA

ATATATCAACCTGTATAACCAGAAAACCAAACAGAAACTGCCGAAATTCAAACCGCTGTATAAACAGGTTCTGAGCG

ATCGTGAAAGCCTGAGCTTTTATGGTGAAGGTTATACCAGTGATGAAGAGGTTCTGGAAGTTTTTCGTAACACCCTG

AATAAAAACAGCGAGATCTTTAGCAGCATCAAAAAGCTTGAGAAACTGTTCAAAAACTTTGATGAGTATAGCAGCGC

AGGCATCTTTGTTAAAAATGGTCCGGCAATTAGCACCATCAGCAAAGATATTTTTGGCAATGGAATGTGATCCGCG

ATAAATGGAATGCCGAATATGATGATATCCACCTGAAAAAAAAGGCCGTGGTGACCGAGAAATATGAAGATGATCGT

CGTAAAAGCTTCAAGAAAATTGGTAGCTTTAGCCTGGAACAGCTGCAAGAATATGCAGATGCAGATCTGAGCGTTGT

GGAAAAAACTGAAAGAAATCATCATTCAGAAGGTGGACGAGATCTATAAAGTTTATGGTAGCAGCGAAAAACTGTTCG

ATGCAGATTTTGTTCTGGAAAAAAGCCTGAAAAAGAATGATGCCGTTGTGGCCATTATGAAAGATCTGCTGGATAGC

GTTAAGAGCTTCGAGAATTACATCAAAGCCTTTTTTGGTGAGGGCAAAGAAACCAATCGTGATGAAAGTTTCTATGG

CGATTTTGTGCTGGCCTATGATATTCTGCTGAAAGTGGACCATATTTATGATGCCATTCGCAATTATGTTACCCAGA

AACCGTATAGCAAAGACAAGTTCAAACTGTACTTTCAGAACCCGCAGTTTATGGGTGGTTGGGATAAAGATAAAGAA

ACCGATTATCGTGCCACCATCCTGCGTTATGGTAGTAAATACTATCTGGCCATCATGGACAAAAAATACGCAAAATG

CCTGCAGAAAATCGACAAAGATGATGTGAATGGCAACTATGAAAAAATCAACTACAAACTGCTGCCTGGTCCGAATA

AAATGCTGCCGAAAGTGTTCTTTAGCAAGAAATGGATGGCCTATTATAACCCGAGCGAGGATATTCAAAAGATCTAC

AAAAATGGCACCTTTAAAAAGGGCGACATGTTCAATCTGAACGATTGCCACAAACTGATCGATTTCTTCAAAGATTC

AATTTCGCGTTATCCGAAATGGTCCAATGCCTATGATTTTAACTTTAGCGAAACCGAAAAATACAAAGACATTGCCG

GTTTTTATCGCGAAGTGGAAGAACAGGGCTATAAAGTGAGCTTTGAAAGCGCAAGCAAAAAGAGGTTGATAAGCTG

GTTGAAGAGGGCAAACTGTATATGTTCCAGATTTACAACAAAGATTTTAGCGACAAAAGCCATGGCACCCCGAATCT

GCATACCATGTACTTTAAACTGCTGTTCGACGAAAATAACCATGGTCAGATTCGTCTGAGCGGTGGTGCCGAACTGT

TTATGCGTCGTGCAAGTCTGAAAAAAGAAGAACTGGTTGTTCATCCGGCAAATAGCCCGATTGCAAACAAAAATCCG

GACAATCCGAAAAAAACCACGACACTGAGCTATGATGTGTATAAAGACAAACGTTTTAGCGAGGATCAGTATCTGCT

GCATATCCCGATTGCCATCAATAAATGCCCGAAAAACATCTTTAAGATCAACACCGAAGTTCGCGTGCTGCTGAAAC

ATGATGATAATCCGTATGTGATTGGCATTGATCGTGGTGAACGTAACCTGCTGTATATTGTTGTTGTTGATGGTAAA

GGCAACATCGTGGAACAGTATAGTCTGAACGAAATTATCAACAACTTTAACGGCATCCGCATCAAAACCGACTATCA

TAGCCTGCTGGACAAGAAAGAAAAAGAACGTTTTGAAGCACGTCAGAACTGGACCAGTATTGAAAACATCAAAGAAC

TGAAAGCCGGTTATATTAGCCAGGTGGTTCATAAAATCTGTGAGCTGGTAGAAAAATACGATGCAGTTATTGCACTG

-continued

GAAGATCTGAATAGCGGTTTCAAAAATAGCCGTGTGAAAGTCGAAAAACAGGTGTATCAGAAATTCGAGAAAATGCT
GATCGACAAACTGAACTACATGGTCGACAAAAAAAGCAATCCGTGTGCAACCGGTGGTGCACTGAAAGGTTATCAGA
TTACCAACAAATTTGAAAGCTTTAAAAGCATGAGCACCCAGAACGGCTTTATCTTCTATATTCCGGCATGGCTGACC
AGCAAAATTGATCCGAGCACCGGTTTTGTGAACCTGCTGAAAACAAAATATACCTCCATTGCCGACAGCAAGAAGTT
TATTAGCAGCTTTGATCGCATTATGTATGTTCCGGAAGAGGACCTGTTTGAATTCGCACTGGATTACAAAAATTTCA
GCCGTACCGATGCCGACTACATCAAAAAATGGAAACTGTACAGCTATGGTAACCGCATTCGCATTTTTCGCAACCCG
AAGAAAAACAATGTGTTCGATTGGGAAGAAGTTTGTCTGACCAGCGCATATAAAGAACTTTTCAACAAATACGGCAT
CAACTATCAGCAGGGTGATATTCGTGCACTGCTGTGTGAACAGAGCGATAAAGCGTTTTATAGCAGTTTTATGGCAC
TGATGAGCCTGATGCTGCAGATGCGTAATAGCATTACCGGTCGCACCGATGTGGATTTTCTGATTAGTCCGGTGAAA
AATTCCGATGGCATCTTTTATGATAGCCGCAATTACGAAGCACAAGAAAATGCAATTCTGCCGAAAAACGCAGATGC
AAATGGTGCATATAACATTGCACGTAAAGTTCTGTGGGCAATTGGCCAGTTTAAGAAAGCAGAAGATGAGAAGCTGG
ACAAAGTGAAAATTGCGATCAGCAATAAAGAGTGGCTGGAATACGCACAGACCAGCGTTAAACATGCGCCAGCGCCT
GCTCCTGCACCCGCTCCAGCTCCTGCCCCAGCTCCAGCGCCCGCTCCTGCGCCAGCTCCTGCACCTGCGATGGTTAG
CAAAGGTGAAGAACTGTTTACCGGCGTTGTGCCGATTCTGGTGGAACTGGATGGTGATGTGAATGGCCATAAATTTA
GCGTTAGCGGCGAAGGCGAAGGTGATGCGACCTATGGTAAACTGACCCTGAAATTTATTTGCACCACCGGTAAACTG
CCGGTTCCGTGGCCGACCCTGGTGACCACCCTGACCTATGGCGTTCAGTGCTTTAGCCGCTATCCGGATCATATGAA
ACAGCATGATTTCTTTAAAAGCGCGATGCCGGAAGGCTATGTGCAGGAACGTACCATTTTTTTCAAAGATGATGGCA
ACTATAAAACCCGTGCGGAAGTTAAATTTGAAGGCGATACCCTGGTGAACCGCATTGAACTGAAAGGTATTGATTTT
AAAGAAGATGGCAACATTCTGGGTCATAAACTGGAATATAATTACAACAGCCATAATGTGTATATTATGGCCGATAA
ACAGAAAAATGGCATCAAAGTGAACTTTAAAATCCGTCACAACATTGAAGATGGTAGCGTGCAGCTGGCGGATCATT
ATCAGCAGAATACCCCGATTGGTGATGGCCCGGTGCTGCTGCCGGATAACCATTATCTGAGCACCCAGAGCGCGCTG
AGCAAAGATCCGAATGAAAAACGTGATCATATGGTGCTGCTGGAATTTGTTACCGCCGCGGGCATTACCCTGGGTAT
GGATGAACTGTATAAA (LbCas12a (E795L)-APAPAPAPAPAPAPAPAPAPAPAPAPAPAPA-eGFP chimera DNA sequence)
SEQ ID NO: 408
ATGAGCAAACTGGAAAAGTTCACCAACTGTTATAGCCTGAGCAAAACCCTGCGTTTTAAAGCAATTCCGGTTGGTAA
AACCCAAGAGAACATTGATAATAAACGCCTGCTGGTCGAAGATGAAAAACGCGCTGAAGATTATAAAGGCGTGAAAA
AACTGCTGGATCGCTATTATCTGAGCTTCATTAACGATGTGCTGCACAGCATTAAACTGAAGAACCTGAACAACTAT
ATCAGCCTGTTTCGTAAAAAAACCCGCACCGAAAAAGAAAACAAAGAGCTGGAAAACCTGGAAATCAATCTGCGTAA
AGAAATCGCCAAAGCGTTTAAAGGTAACGAGGGTTATAAAAGCCTGTTCAAGAAAGACATCATCGAAACCATTCTGC
CGGAATTTCTGGATGATAAAGATGAAATTGCCCTGGTGAATAGCTTTAATGGCTTTACCACCGCATTTACCGGCTTT
TTTGATAATCGCGAAAACATGTTCAGCGAAGAAGCAAAAAGCACCAGCATTGCATTTCGCTGCATTAATGAAAATCT
GACCCGCTACATTAGCAACATGGATATCTTTGAAAAAGTGGACGCGATCTTCGATAAACACGAAGTGCAAGAGATCA
AAGAGAAAATCCTGAACAGCGATTATGACGTCGAAGATTTTTTTGAAGGCGAGTTCTTTAACTTCGTTCTGACCCAA
GAAGGTATCGACGTTTATAACGCAATTATTGGTGGTTTTGTTACCGAAAGCGGTGAGAAAATCAAAGGCCTGAATGA
ATATATCAACCTGTATAACCAGAAAACCAAACAGAAACTGCCGAAATTCAAACCGCTGTATAAACAGGTTCTGAGCG
ATCGTGAAAGCCTGAGCTTTTATGGTGAAGGTTATACCAGTGATGAAGAGGTTCTGGAAGTTTTTCGTAACACCCTG
AATAAAAACAGCGAGATCTTTAGCAGCATCAAAAAGCTTGAGAAACTGTTCAAAAACTTTGATGAGTATAGCAGCGC
AGGCATCTTTGTTAAAAATGGTCCGGCAATTAGCACCATCAGCAAAGATATTTTTGGCGAATGGAATGTGATCCGCG
ATAAATGGAATGCCGAATATGATGATATCCACCTGAAAAAAAGGCCGTGGTGACCGAGAAATATGAAGATGATCGT
CGTAAAAGCTTCAAGAAAATTGGTAGCTTTAGCCTGGAACAGCTGCAAGAATATGCAGATGCAGATCTGAGCGTTGT
GGAAAAACTGAAAGAAATCATCATTCAGAAGGTGGACGAGATCTATAAAGTTTATGGTAGCAGCGAAAAACTGTTCG -continued

```
ATGCAGATTTTGTTCTGGAAAAAAGCCTGAAAAAGAATGATGCCGTTGTGGCCATTATGAAAGATCTGCTGGATAGC
GTTAAGAGCTTCGAGAATTACATCAAAGCCTTTTTTGGTGAGGGCAAAGAAACCAATCGTGATGAAAGTTTCTATGG
CGATTTTGTGCTGGCCTATGATATTCTGCTGAAAGTGGACCATATTTATGATGCCATTCGCAATTATGTTACCCAGA
AACCGTATAGCAAAGACAAGTTCAAACTGTACTTTCAGAACCCGCAGTTTATGGGTGGTTGGGATAAAGATAAAGAA
ACCGATTATCGTGCCACCATCCTGCGTTATGGTAGTAAATACTATCTGGCCATCATGGACAAAAAATACGCAAAATG
CCTGCAGAAAATCGACAAAGATGATGTGAATGGCAACTATGAAAAAATCAACTACAAACTGCTGCCTGGTCCGAATA
AAATGCTGCCGAAAGTGTTCTTTAGCAAGAAATGGATGGCCTATTATAACCCGAGCGAGGATATTCAAAAGATCTAC
AAAAATGGCACCTTTAAAAAGGGCGACATGTTCAATCTGAACGATTGCCACAAACTGATCGATTTCTTCAAAGATTC
AATTTCGCGTTATCCGAAATGGTCCAATGCCTATGATTTTAACTTTAGCGAAACCGAAAAATACAAAGACATTGCCG
GTTTTTATCGCGAAGTGGAAGAACAGGGCTATAAAGTGAGCTTTGAAAGCGCAAGCAAAAAGAGGTTGATAAGCTG
GTTGAAGAGGGCAAACTGTATATGTTCCAGATTTACAACAAAGATTTTAGCGACAAAAGCCATGGCACCCCGAATCT
GCATACCATGTACTTTAAACTGCTGTTCGACGAAAATAACCATGGTCAGATTCGTCTGAGCGGTGGTGCCGAACTGT
TTATGCGTCGTGCAAGTCTGAAAAAGAAGAACTGGTTGTTCATCCGGCAAATAGCCCGATTGCAAACAAAAATCCG
GACAATCCGAAAAAAACCACGACACTGAGCTATGATGTGTATAAAGACAAACGTTTTAGCGAGGATCAGTATCTGCT
GCATATCCCGATTGCCATCAATAAATGCCCGAAAAACATCTTTAAGATCAACACCGAAGTTCGCGTGCTGCTGAAAC
ATGATGATAATCCGTATGTGATTGGCATTGATCGTGGTAACGTAACCTGCTGTATATTGTTGTTGTTGATGGTAAA
GGCAACATCGTGGAACAGTATAGTCTGAACGAAATTATCAACAACTTTAACGGCATCCGCATCAAAACCGACTATCA
TAGCCTGCTGGACAAGAAAGAAAAAGAACGTTTTGAAGCACGTCAGAACTGGACCAGTATTGAAAACATCAAAGAAC
TGAAAGCCGGTTATATTAGCCAGGTGGTTCATAAAATCTGTGAGCTGGTAGAAAAATACGATGCAGTTATTGCACTG
GAAGATCTGAATAGCGGTTTCAAAAATAGCCGTGTGAAAGTCGAAAAACAGGTGTATCAGAAATTCGAGAAAATGCT
GATCGACAAACTGAACTACATGGTCGACAAAAAAAGCAATCCGTGTGCAACCGGTGGTGCACTGAAAGGTTATCAGA
TTACCAACAAATTTGAAAGCTTTAAAAGCATGAGCACCCAGAACGGCTTTATCTTCTATATTCCGGCATGGCTGACC
AGCAAAATTGATCCGAGCACCGGTTTTGTGAACCTGCTGAAAACAAAATATACCTCCATTGCCGACAGCAAGAAGTT
TATTAGCAGCTTTGATCGCATTATGTATGTTCCGGAAGAGGACCTGTTTGAATTCGCACTGGATTACAAAAATTTCA
GCCGTACCGATGCCGACTACATCAAAAAATGGAAACTGTACAGCTATGGTAACCGCATTCGCATTTTTCGCAACCCG
AAGAAAAACAATGTGTTCGATTGGGAAGAAGTTTGTCTGACCAGCGCATATAAAGAACTTTTCAACAAATACGGCAT
CAACTATCAGCAGGGTGATATTCGTGCACTGCTGTGTGAACAGAGCGATAAAGCGTTTTATAGCAGTTTTATGGCAC
TGATGAGCCTGATGCTGCAGATGCGTAATAGCATTACCGGTCGCACCGATGTGGATTTTCTGATTAGTCCGGTGAAA
AATTCCGATGGCATCTTTTATGATAGCCGCAATTACGAAGCACAAGAAAATGCAATTCTGCCGAAAAACGCAGATGC
AAATGGTGCATATAACATTGCACGTAAAGTTCTGTGGGCAATTGGCCAGTTTAAGAAAGCAGAAGATGAGAAGCTGG
ACAAAGTGAAAATTGCGATCAGCAATAAAGAGTGGCTGGAATACGCACAGACCAGCGTTAAACATGCGCCAGCGCCT
GCTCCTGCACCCGCTCCAGCTCCTGCCCCAGCTCCAGCGCCCGCTCCTGCGCCAGCTCCTGCACCTGCTCCAGCGAT
GGTTAGCAAAGGTGAAGAACTGTTTACCGGCGTTGTGCCGATTCTGGTGGAACTGGATGGTGATGTGAATGGCCATA
AATTTAGCGTTAGCGGCGAAGGCGAAGGTGATGCGACCTATGGTAAACTGACCCTGAAATTTATTTGCACCACCGGT
AAACTGCCGGTTCCGTGGCCGACCCTGGTGACCACCCTGACCTATGGCGTTCAGTGCTTTAGCCGCTATCCGGATCA
TATGAAACAGCATGATTTCTTTAAAAGCGCGATGCCGGAAGGCTATGTGCAGGAACGTACCATTTTTTTCAAAGATG
ATGGCAACTATAAAACCCGTGCGGAAGTTAAATTTGAAGGCGATACCCTGGTGAACCGCATTGAACTGAAAGGTATT
GATTTTAAAGAAGATGGCAACATTCTGGGTCATAAACTGGAATATAATTACAACAGCCATAATGTGTATATTATGGC
CGATAAACAGAAAAATGGCATCAAAGTGAACTTTAAAATCCGTCACAACATTGAAGATGGTAGCGTGCAGCTGGCGG
ATCATTATCAGCAGAATACCCCGATTGGTGATGGCCCGGTGCTGCTGCCGGATAATCATTATCTGAGCACCCAGAGC
```

-continued

GCGCTGAGCAAAGATCCGAATGAAAAACGTGATCATATGGTGCTGCTGGAATTTGTTACCGCCGCGGGCATTACCCT

GGGTATGGATGAACTGTATAAA (LbCas12a (E795L)-mCherry chimera DNA sequence)

SEQ ID NO: 409

ATGAGCAAACTGGAAAAGTTCACCAACTGTTATAGCCTGAGCAAAACCCTGCGTTTTAAAGCAATTCCGGTTGGTAA

AACCCAAGAGAACATTGATAATAAACGCCTGCTGGTCGAAGATGAAAAACGCGCTGAAGATTATAAAGGCGTGAAAA

AACTGCTGGATCGCTATTATCTGAGCTTCATTAACGATGTGCTGCACAGCATTAAACTGAAGAACCTGAACAACTAT

ATCAGCCTGTTTCGTAAAAAAACCCGCACCGAAAAAGAAAACAAAGAGCTGGAAAACCTGGAAATCAATCTGCGTAA

AGAAATCGCCAAAGCGTTTAAAGGTAACGAGGGTTATAAAAGCCTGTTCAAGAAAGACATCATCGAAACCATTCTGC

CGGAATTTCTGGATGATAAAGATGAAATTGCCCTGGTGAATAGCTTTAATGGCTTTACCACCGCATTTACCGGCTTT

TTTGATAATCGCGAAAACATGTTCAGCGAAGAAGCAAAAAGCACCAGCATTGCATTTCGCTGCATTAATGAAAATCT

GACCCGCTACATTAGCAACATGGATATCTTTGAAAAAGTGGACGCGATCTTCGATAAACACGAAGTGCAAGAGATCA

AAGAGAAATCCTGAACAGCGATTATGACGTCGAAGATTTTTTTGAAGGCGAGTTCTTTAACTTCGTTCTGACCCAA

GAAGGTATCGACGTTTATAACGCAATTATTGGTGGTTTTGTTACCGAAAGCGGTGAGAAAATCAAAGGCCTGAATGA

ATATATCAACCTGTATAACCAGAAAACCAAACAGAAACTGCCGAAATTCAAACCGCTGTATAAACAGGTTCTGAGCG

ATCGTGAAAGCCTGAGCTTTTATGGTGAAGGTTATACCAGTGATGAAGAGGTTCTGGAAGTTTTTCGTAACACCCTG

AATAAAAACAGCGAGATCTTTAGCAGCATCAAAAAGCTTGAGAAACTGTTCAAAAACTTTGATGAGTATAGCAGCGC

AGGCATCTTTGTTAAAAATGGTCCGGCAATTAGCACCATCAGCAAAGATATTTTTGGCGAATGGAATGTGATCCGCG

ATAAATGGAATGCCGAATATGATGATATCCACCTGAAAAAAAAGGCCGTGGTGACCGAGAAATATGAAGATGATCGT

CGTAAAAGCTTCAAGAAAATTGGTAGCTTTAGCCTGGAACAGCTGCAAGAATATGCAGATGCAGATCTGAGCGTTGT

GGAAAAACTGAAAGAAATCATCATTCAGAAGGTGGACGAGATCTATAAAGTTTATGGTAGCAGCGAAAAACTGTTCG

ATGCAGATTTTGTTCTGGAAAAAAGCCTGAAAAAGAATGATGCCGTTGTGGCCATTATGAAAGATCTGCTGGATAGC

GTTAAGAGCTTCGAGAATTACATCAAAGCCTTTTTTGGTGAGGGCAAAGAAACCAATCGTGATGAAAGTTTCTATGG

CGATTTTGTGCTGGCCTATGATATTCTGCTGAAAGTGGACCATATTTATGATGCCATTCGCAATTATGTTACCCAGA

AACCGTATAGCAAAGACAAGTTCAAACTGTACTTTCAGAACCCGCAGTTTATGGGTGGTTGGGATAAAGATAAAGAA

ACCGATTATCGTGCCACCATCCTGCGTTATGGTAGTAAATACTATCTGGCCATCATGGACAAAAAATACGCAAAATG

CCTGCAGAAAATCGACAAAGATGATGTGAATGGCAACTATGAAAAAATCAACTACAAACTGCTGCCTGGTCCGAATA

AAATGCTGCCGAAAGTGTTCTTTAGCAAGAAATGGATGGCCTATTATAACCCGAGCGAGGATATTCAAAAGATCTAC

AAAAATGGCACCTTTAAAAAGGGCGACATGTTCAATCTGAACGATTGCCACAAACTGATCGATTTCTTCAAAGATTC

AATTTCGCGTTATCCGAAATGGTCCAATGCCTATGATTTTAACTTTAGCGAAACCGAAAAATACAAAGACATTGCCG

GTTTTTATCGCGAAGTGGAAGAACAGGGCTATAAAGTGAGCTTTGAAAGCGCAAGCAAAAAGGAGGTTGATAAGCTG

GTTGAAGAGGGCAAACTGTATATGTTCCAGATTTACAACAAAGATTTTAGCGACAAAAGCCATGGCACCCCGAATCT

GCATACCATGTACTTTAAACTGCTGTTCGACGAAAATAACCATGGTCAGATTCGTCTGAGCGGTGGTGCCGAACTGT

TTATGCGTCGTGCAAGTCTGAAAAAAGAAGAACTGGTTGTTCATCCGGCAAATAGCCCGATTGCAAACAAAAATCCG

GACAATCCGAAAAAAACCACGACACTGAGCTATGATGTGTATAAAGACAAACGTTTTAGCGAGGATCAGTATCTGCT

GCATATCCCGATTGCCATCAATAAATGCCCGAAAAACATCTTTAAGATCAACACCGAAGTTCGCGTGCTGCTGAAAC

ATGATGATAATCCGTATGTGATTGGCATTGATCGTGGTGAACGTAACCTGCTGTATATTGTTGTTGTTGATGGTAAA

GGCAACATCGTGGAACAGTATAGTCTGAACGAAATTATCAACAACTTTAACGGCATCCGCATCAAAACCGACTATCA

TAGCCTGCTGGACAAGAAAGAAAAAGAACGTTTTGAAGCACGTCAGAACTGGACCAGTATTGAAAACATCAAAGAAC

TGAAAGCCGGTTATATTAGCCAGGTGGTTCATAAAATCTGTGAGCTGGTAGAAAAATACGATGCAGTTATTGCACTG

GAAGATCTGAATAGCGGTTTCAAAAATAGCCGTGTGAAAGTCGAAAAACAGGTGTATCAGAAATTCGAGAAAATGCT

GATCGACAAACTGAACTACATGGTCGACAAAAAAAGCAATCCGTGTGCAACCGGTGGTGCACTGAAAGGTTATCAGA

-continued

```
TTACCAACAAATTTGAAAGCTTTAAAAGCATGAGCACCCAGAACGGCTTTATCTTCTATATTCCGGCATGGCTGACC

AGCAAAATTGATCCGAGCACCGGTTTTGTGAACCTGCTGAAAACAAAATATACCTCCATTGCCGACAGCAAGAAGTT

TATTAGCAGCTTTGATCGCATTATGTATGTTCCGGAAGAGGACCTGTTTGAATTCGCACTGGATTACAAAAATTTCA

GCCGTACCGATGCCGACTACATCAAAAAATGGAAACTGTACAGCTATGGTAACCGCATTCGCATTTTTCGCAACCCG

AAGAAAAACAATGTGTTCGATTGGGAAGAAGTTTGTCTGACCAGCGCATATAAAGAACTTTTCAACAAATACGGCAT

CAACTATCAGCAGGGTGATATTCGTGCACTGCTGTGTGAACAGAGCGATAAAGCGTTTTATAGCAGTTTTATGGCAC

TGATGAGCCTGATGCTGCAGATGCGTAATAGCATTACCGGTCGCACCGATGTGGATTTTCTGATTAGTCCGGTGAAA

AATTCCGATGGCATCTTTTATGATAGCCGCAATTACGAAGCACAAGAAAATGCAATTCTGCCGAAAAACGCAGATGC

AAATGGTGCATATAACATTGCACGTAAAGTTCTGTGGGCAATTGGCCAGTTTAAGAAAGCAGAAGATGAGAAGCTGG

ACAAAGTGAAAATTGCGATCAGCAATAAAGAGTGGCTGGAATACGCACAGACCAGCGTTAAACATATGGTGAGCAAA

GGTGAAGAGGATAATATGGCCATCATCAAAGAATTCATGCGCTTCAAAGTTCATATGGAAGGTAGCGTTAATGGCCA

CGAATTTGAAATTGAAGGTGAAGGCGAAGGTCGTCCGTATGAAGGCACCCAGACCGCAAAACTGAAAGTTACCAAAG

GTGGTCCGCTGCCGTTTGCATGGGATATTCTGAGTCCGCAGTTTATGTATGGTAGCAAAGCCTATGTTAAACATCCG

GCAGATATCCCGGATTATCTGAAACTGAGCTTTCCGGAAGGTTTTAAATGGGAACGTGTGATGAATTTTGAAGATGG

TGGTGTTGTTACCGTTACACAGGATAGCAGCCTGCAGGATGGTGAATTTATCTATAAAGTTAAACTGCGTGGCACGA

ATTTTCCGAGTGATGGTCCGGTTATGCAGAAAAAAACCATGGGTTGGGAAGCAAGCAGCGAACGTATGTATCCGGAA

GATGGCGCACTGAAAGGTGAAATTAAACAGCGTCTGAAGCTGAAAGATGGCGGTCATTATGATGCAGAAGTTAAAAC

CACCTACAAAGCCAAAAAACCGGTTCAGCTGCCTGGTGCATATAACGTTAACATTAAACTGGATATCACCAGCCACA

ACGAGGATTATACCATTGTTGAACAGTATGAACGTGCAGAAGGTCGCCATAGTACCGGTGGTATGGATGAACTGTAT

AAA (LbCas12a(E795L)-GSAGSAAGSGEF-mCherry chimera DNA sequence)
                                                           SEQ ID NO: 410
ATGAGCAAACTGGAAAAGTTCACCAACTGTTATAGCCTGAGCAAAACCCTGCGTTTTAAAGCAATTCCGGTTGGTAA

AACCCAAGAGAACATTGATAATAAACGCCTGCTGGTCGAAGATGAAAAACGCGCTGAAGATTATAAAGGCGTGAAAA

AACTGCTGGATCGCTATTATCTGAGCTTCATTAACGATGTGCTGCACAGCATTAAACTGAAGAACCTGAACAACTAT

ATCAGCCTGTTTCGTAAAAAAACCCGCACCGAAAAAGAAAACAAAGAGCTGGAAAACCTGGAAATCAATCTGCGTAA

AGAAATCGCCAAAGCGTTTAAAGGTAACGAGGGTTATAAAAGCCTGTTCAAGAAAGACATCATCGAAACCATTCTGC

CGGAATTTCTGGATGATAAAGATGAAATTGCCCTGGTGAATAGCTTTAATGGCTTTACCACCGCATTTACCGGCTTT

TTTGATAATCGCGAAAACATGTTCAGCGAAGAAGCAAAAAGCACCAGCATTGCATTTCGCTGCATTAATGAAAATCT

GACCCGCTACATTAGCAACATGGATATCTTTGAAAAAGTGGACGCGATCTTCGATAAACACGAAGTGCAAGAGATCA

AAGAGAAAATCCTGAACAGCGATTATGACGTCGAAGATTTTTTTGAAGGCGAGTTCTTTAACTTCGTTCTGACCCAA

GAAGGTATCGACGTTTATAACGCAATTATTGGTGGTTTTGTTACCGAAAGCGGTGAGAAAATCAAAGGCCTGAATGA

ATATATCAACCTGTATAACCAGAAAACCAAACAGAAACTGCCGAAATTCAAACCGCTGTATAAACAGGTTCTGAGCG

ATCGTGAAAGCCTGAGCTTTTATGGTGAAGGTTATACCAGTGATGAAGAGGTTCTGGAAGTTTTTCGTAACACCCTG

AATAAAAACAGCGAGATCTTTAGCAGCATCAAAAAGCTTGAGAAACTGTTCAAAAACTTTGATGAGTATAGCAGCGC

AGGCATCTTTGTTAAAAATGGTCCGGCAATTAGCACCATCAGCAAAGATATTTTTGGCGAATGGAATGTGATCCGCG

ATAAATGGAATGCCGAATATGATGATATCCACCTGAAAAAAAAGGCCGTGGTGACCGAGAAATATGAAGATGATCGT

CGTAAAAGCTTCAAGAAAATTGGTAGCTTTAGCCTGGAACAGCTGCAAGAATATGCAGATGCAGATCTGAGCGTTGT

GGAAAAACTGAAAGAAATCATCATTCAGAAGGTGGACGAGATCTATAAAGTTTATGGTAGCAGCGAAAAACTGTTCG

ATGCAGATTTTGTTCTGGAAAAAAGCCTGAAAAAGAATGATGCCGTTGTGGCCATTATGAAAGATCTGCTGGATAGC

GTTAAGAGCTTCGAGAATTACATCAAAGCCTTTTTTGGTGAGGGCAAAGAAACCAATCGTGATGAAAGTTTCTATGG
```

-continued

```
CGATTTTGTGCTGGCCTATGATATTCTGCTGAAAGTGGACCATATTTATGATGCCATTCGCAATTATGTTACCCAGA

AACCGTATAGCAAAGACAAGTTCAAACTGTACTTTCAGAACCCGCAGTTTATGGGTGGTTGGGATAAAGATAAAGAA

ACCGATTATCGTGCCACCATCCTGCGTTATGGTAGTAAATACTATCTGGCCATCATGGACAAAAAATACGCAAAATG

CCTGCAGAAAATCGACAAAGATGATGTGAATGGCAACTATGAAAAAATCAACTACAAACTGCTGCCTGGTCCGAATA

AAATGCTGCCGAAAGTGTTCTTTAGCAAGAAATGGATGGCCTATTATAACCCGAGCGAGGATATTCAAAGATCTAC

AAAAATGGCACCTTTAAAAAGGGCGACATGTTCAATCTGAACGATTGCCACAAACTGATCGATTTCTTCAAAGATTC

AATTTCGCGTTATCCGAAATGGTCCAATGCCTATGATTTTAACTTTAGCGAAACCGAAAAATACAAAGACATTGCCG

GTTTTTATCGCGAAGTGGAAGAACAGGGCTATAAAGTGAGCTTTGAAAGCGCAAGCAAAAAGAGGTTGATAAGCTG

GTTGAAGAGGGCAAACTGTATATGTTCCAGATTTACAACAAAGATTTTAGCGACAAAAGCCATGGCACCCCGAATCT

GCATACCATGTACTTTAAACTGCTGTTCGACGAAAATAACCATGGTCAGATTCGTCTGAGCGGTGGTGCCGAACTGT

TTATGCGTCGTGCAAGTCTGAAAAAAGAAGAACTGGTTGTTCATCCGGCAAATAGCCCGATTGCAAACAAAAATCCG

GACAATCCGAAAAAAACCACGACACTGAGCTATGATGTGTATAAAGACAAACGTTTTAGCGAGGATCAGTATCTGCT

GCATATCCCGATTGCCATCAATAAATGCCCGAAAAACATCTTTAAGATCAACACCGAAGTTCGCGTGCTGCTGAAAC

ATGATGATAATCCGTATGTGATTGGCATTGATCGTGGTGAACGTAACCTGCTGTATATTGTTGTTGTTGATGGTAAA

GGCAACATCGTGGAACAGTATAGTCTGAACGAAATTATCAACAACTTTAACGGCATCCGCATCAAAACCGACTATCA

TAGCCTGCTGGACAAGAAAGAAAAAGAACGTTTTGAAGCACGTCAGAACTGGACCAGTATTGAAAACATCAAAGAAC

TGAAAGCCGGTTATATTAGCCAGGTGGTTCATAAAATCTGTGAGCTGGTAGAAAAATACGATGCAGTTATTGCACTG

GAAGATCTGAATAGCGGTTTCAAAAATAGCCGTGTGAAAGTCGAAAAACAGGTGTATCAGAAATTCGAGAAAATGCT

GATCGACAAACTGAACTACATGGTCGACAAAAAAAGCAATCCGTGTGCAACCGGTGGTGCACTGAAAGGTTATCAGA

TTACCAACAAATTTGAAAGCTTTAAAAGCATGAGCACCCAGAACGGCTTTATCTTCTATATTCCGGCATGGCTGACC

AGCAAAATTGATCCGAGCACCGGTTTTGTGAACCTGCTGAAAACAAAATATACCTCCATTGCCGACAGCAAGAAGTT

TATTAGCAGCTTTGATCGCATTATGTATGTTCCGGAAGAGGACCTGTTTGAATTCGCACTGGATTACAAAAATTTCA

GCCGTACCGATGCCGACTACATCAAAAAATGGAAACTGTACAGCTATGGTAACCGCATTCGCATTTTTCGCAACCCG

AAGAAAAACAATGTGTTCGATTGGGAAGAAGTTTGTCTGACCAGCGCATATAAAGAACTTTTCAACAAATACGGCAT

CAACTATCAGCAGGGTGATATTCGTGCACTGCTGTGTGAACAGAGCGATAAAGCGTTTTATAGCAGTTTTATGGCAC

TGATGAGCCTGATGCTGCAGATGCGTAATAGCATTACCGGTCGCACCGATGTGGATTTTCTGATTAGTCCGGTGAAA

AATTCCGATGGCATCTTTTATGATAGCCGCAATTACGAAGCACAAGAAATGCAATTCTGCCGAAAAACGCAGATGC

AAATGGTGCATATAACATTGCACGTAAAGTTCTGTGGGCAATTGGCCAGTTTAAGAAAGCAGAAGATGAGAAGCTGG

ACAAAGTGAAAATTGCGATCAGCAATAAAGAGTGGCTGGAATACGCACAGACCAGCGTTAAACATGGTAGCGCAGGT

AGTGCAGCAGGTAGCGGTGAATTTATGGTGAGCAAAGGTGAAGAGGATAATATGGCCATCATCAAAGAATTCATGCG

CTTCAAAGTTCATATGGAAGGTAGCGTTAATGGCCACGAATTTGAAATTGAAGGTGAAGGCGAAGGTCGTCCGTATG

AAGGCACCCAGACCGCAAAACTGAAAGTTACCAAAGGTGGTCCGCTGCCGTTTGCATGGGATATTCTGAGTCCGCAG

TTTATGTATGGTAGCAAAGCCTATGTTAAACATCCGGCAGATATCCCGGATTATCTGAAACTGAGCTTTCCGGAAGG

TTTTAAATGGGAACGTGTGATGAATTTTGAAGATGGTGGTGTTGTTACCGTTACACAGGATAGCAGCCTGCAGGATG

GTGAATTTATCTATAAAGTTAAACTGCGTGGCACGAATTTTCCGAGTGATGGTCCGGTTATGCAGAAAAAAACCATG

GGTTGGGAAGCAAGCAGCGAACGTATGTATCCGGAAGATGGCGCACTGAAAGGTGAAATTAAACAGCGTCTGAAGCT

GAAAGATGGCGGTCATTATGATGCAGAAGTTAAAACCACCTACAAAGCCAAAAAACCGGTTCAGCTGCCTGGTGCAT

ATAACGTTAACATTAAACTGGATATCACCAGCCACAACGAGGATTATACCATTGTTGAACAGTATGAACGTGCAGAA

GGTCGCCATAGTACCGGTGGTATGGATGAACTGTATAAA
```

-continued (LbCas12a (E795L)-(GGGGS)₄-mCherry chimera DNA sequence)

SEQ ID NO: 411

ATGAGCAAACTGGAAAAGTTCACCAACTGTTATAGCCTGAGCAAAACCCTGCGTTTTAAAGCAATTCCGGTTGGTAA

AACCCAAGAGAACATTGATAATAAACGCCTGCTGGTCGAAGATGAAAAACGCGCTGAAGATTATAAAGGCGTGAAAA

AACTGCTGGATCGCTATTATCTGAGCTTCATTAACGATGTGCTGCACAGCATTAAACTGAAGAACCTGAACAACTAT

ATCAGCCTGTTTCGTAAAAAAACCCGCACCGAAAAGAAAACAAAGAGCTGGAAAACCTGGAAATCAATCTGCGTAA

AGAAATCGCCAAAGCGTTTAAAGGTAACGAGGGTTATAAAAGCCTGTTCAAGAAAGACATCATCGAAACCATTCTGC

CGGAATTTCTGGATGATAAAGATGAAATTGCCCTGGTGAATAGCTTTAATGGCTTTACCACCGCATTTACCGGCTTT

TTTGATAATCGCGAAAACATGTTCAGCGAAGAAGCAAAAAGCACCAGCATTGCATTTCGCTGCATTAATGAAATCT

GACCCGCTACATTAGCAACATGGATATCTTTGAAAAAGTGGACGCGATCTTCGATAAACACGAAGTGCAAGAGATCA

AAGAGAAAATCCTGAACAGCGATTATGACGTCGAAGATTTTTTTGAAGGCGAGTTCTTTAACTTCGTTCTGACCCAA

GAAGGTATCGACGTTTATAACGCAATTATTGGTGGTTTTGTTACCGAAAGCGGTGAGAAAATCAAAGGCCTGAATGA

ATATATCAACCTGTATAACCAGAAAACCAAACAGAAACTGCCGAAATTCAAACCGCTGTATAAACAGGTTCTGAGCG

ATCGTGAAAGCCTGAGCTTTTATGGTGAAGGTTATACCAGTGATGAAGAGGTTCTGGAAGTTTTTCGTAACACCCTG

AATAAAAACAGCGAGATCTTTAGCAGCATCAAAAAGCTTGAGAAACTGTTCAAAAACTTTGATGAGTATAGCAGCGC

AGGCATCTTTGTTAAAAATGGTCCGGCAATTAGCACCATCAGCAAAGATATTTTTGGCGAATGGAATGTGATCCGCG

ATAAATGGAATGCCGAATATGATGATATCCACCTGAAAAAAAAGGCCGTGGTGACCGAGAAATATGAAGATGATCGT

CGTAAAAGCTTCAAGAAAATTGGTAGCTTTAGCCTGGAACAGCTGCAAGAATATGCAGATGCAGATCTGAGCGTTGT

GGAAAAACTGAAAGAAATCATCATTCAGAAGGTGGACGAGATCTATAAAGTTTATGGTAGCAGCGAAAAACTGTTCG

ATGCAGATTTTGTTCTGGAAAAAAGCCTGAAAAAGAATGATGCCGTTGTGGCCATTATGAAAGATCTGCTGGATAGC

GTTAAGAGCTTCGAGAATTACATCAAAGCCTTTTTTGGTGAGGGCAAAGAAACCAATCGTGATGAAAGTTTCTATGG

CGATTTTGTGCTGGCCTATGATATTCTGCTGAAAGTGGACCATATTTATGATGCCATTCGCAATTATGTTACCCAGA

AACCGTATAGCAAAGACAAGTTCAAACTGTACTTTCAGAACCCGCAGTTTATGGGTGGTTGGGATAAAGATAAGAA

ACCGATTATCGTGCCACCATCCTGCGTTATGGTAGTAAATACTATCTGGCCATCATGGACAAAAAATACGCAAAATG

CCTGCAGAAAATCGACAAAGATGATGTGAATGGCAACTATGAAAAAATCAACTACAAACTGCTGCCTGGTCCGAATA

AAATGCTGCCGAAAGTGTTCTTTAGCAAGAAATGGATGGCCTATTATAACCCGAGCGAGGATATTCAAAAGATCTAC

AAAAATGGCACCTTTAAAAAGGGCGACATGTTCAATCTGAACGATTGCCACAAACTGATCGATTTCTTCAAAGATTC

AATTTCGCGTTATCCGAAATGGTCCAATGCCTATGATTTTAACTTTAGCGAAACCGAAAAATACAAAGACATTGCCG

GTTTTTATCGCGAAGTGGAAGAACAGGGCTATAAAGTGAGCTTTGAAAGCGCAAGCAAAAAAGAGGTTGATAAGCTG

GTTGAAGAGGGCAAACTGTATATGTTCCAGATTTACAACAAAGATTTTAGCGACAAAAGCCATGGCACCCCGAATCT

GCATACCATGTACTTTAAACTGCTGTTCGACGAAAATAACCATGGTCAGATTCGTCTGAGCGGTGGTGCCGAACTGT

TTATGCGTCGTGCAAGTCTGAAAAAAGAAGAACTGGTTGTTCATCCGGCAAATAGCCCGATTGCAAACAAAAATCCG

GACAATCCGAAAAAAACCACGACACTGAGCTATGATGTGTATAAAGACAAACGTTTTAGCGAGGATCAGTATCTGCT

GCATATCCCGATTGCCATCAATAAATGCCCGAAAAACATCTTTAAGATCAACACCGAAGTTCGCGTGCTGCTGAAAC

ATGATGATAATCCGTATGTGATTGGCATTGATCGTGGTGAACGTAACCTGCTGTATATTGTTGTTGTTGATGGTAAA

GGCAACATCGTGGAACAGTATAGTCTGAACGAAATTATCAACAACTTTAACGGCATCCGCATCAAAACCGACTATCA

TAGCCTGCTGGACAAGAAGAAAAGAACGTTTTGAAGCACGTCAGAACTGGACCAGTATTGAAAACATCAAAGAAC

TGAAAGCCGGTTATATTAGCCAGGTGGTTCATAAAATCTGTGAGCTGGTAGAAAAATACGATGCAGTTATTGCACTG

GAAGATCTGAATAGCGGTTTCAAAAATAGCCGTGTGAAAGTCGAAAAACAGGTGTATCAGAAATTCGAGAAAATGCT

GATCGACAAACTGAACTACATGGTCGACAAAAAAAGCAATCCGTGTGCAACCGGTGGTGCACTGAAAGGTTATCAGA

TTACCAACAAATTTGAAAGCTTTAAAAGCATGAGCACCCAGAACGGCTTTATCTTCTATATTCCGGCATGGCTGACC

-continued

AGCAAAATTGATCCGAGCACCGGTTTTGTGAACCTGCTGAAAACAAAATATACCTCCATTGCCGACAGCAAGAAGTT

TATTAGCAGCTTTGATCGCATTATGTATGTTCCGGAAGAGGACCTGTTTGAATTCGCACTGGATTACAAAAATTTCA

GCCGTACCGATGCCGACTACATCAAAAAATGGAAACTGTACAGCTATGGTAACCGCATTCGCATTTTTCGCAACCCG

AAGAAAAACAATGTGTTCGATTGGGAAGAAGTTTGTCTGACCAGCGCATATAAAGAACTTTTCAACAAATACGGCAT

CAACTATCAGCAGGGTGATATTCGTGCACTGCTGTGTGAACAGAGCGATAAAGCGTTTTATAGCAGTTTTATGGCAC

TGATGAGCCTGATGCTGCAGATGCGTAATAGCATTACCGGTCGCACCGATGTGGATTTTCTGATTAGTCCGGTGAAA

AATTCCGATGGCATCTTTTATGATAGCCGCAATTACGAAGCACAAGAAATGCAATTCTGCCGAAAAACGCAGATGC

AAATGGTGCATATAACATTGCACGTAAAGTTCTGTGGGCAATTGGCCAGTTTAAGAAAGCAGAAGATGAGAAGCTGG

ACAAAGTGAAAATTGCGATCAGCAATAAAGAGTGGCTGGAATACGCACAGACCAGCGTTAAACATGGAGGCGGAGGA

TCAGGCGGTGGCGGAAGTGGTGGAGGTGGGTCGGGAGGTGGTGGTAGCATGGTGAGCAAAGGTGAAGAGGATAATAT

GGCCATCATCAAAGAATTCATGCGCTTCAAAGTTCATATGGAAGGTAGCGTTAATGGCCACGAATTTGAAATTGAAG

GTGAAGGCGAAGGTCGTCCGTATGAAGGCACCCAGACCGCAAAACTGAAAGTTACCAAAGGTGGTCCGCTGCCGTTT

GCATGGGATATTCTGAGTCCGCAGTTTATGTATGGTAGCAAAGCCTATGTTAAACATCCGGCAGATATCCCGGATTA

TCTGAAACTGAGCTTTCCGGAAGGTTTTAAATGGGAACGTGTGATGAATTTTGAAGATGGTGGTGTTGTTACCGTTA

CACAGGATAGCAGCCTGCAGGATGGTGAATTTATCTATAAAGTTAAACTGCGTGGCACGAATTTTCCGAGTGATGGT

CCGGTTATGCAGAAAAAAACCATGGGTTGGGAAGCAAGCAGCGAACGTATGTATCCGGAAGATGGCGCACTGAAAGG

TGAAATTAAACAGCGTCTGAAGCTGAAAGATGGCGGTCATTATGATGCAGAAGTTAAAACCACCTACAAAGCCAAAA

AACCGGTTCAGCTGCCTGGTGCATATAACGTTAACATTAAACTGGATATCACCAGCCACAACGAGGATTATACCATT

GTTGAACAGTATGAACGTGCAGAAGGTCGCCATAGTACCGGTGGTATGGATGAACTGTATAAA (LbCas12a (E795L)-GGGGSEAAAKGGGGS-mCherry chimera DNA sequence)

SEQ ID NO: 412

ATGAGCAAACTGGAAAAGTTCACCAACTGTTATAGCCTGAGCAAAACCCTGCGTTTTAAAGCAATTCCGGTTGGTAA

AACCCAAGAGAACATTGATAATAAACGCCTGCTGGTCGAAGATGAAAAACGCGCTGAAGATTATAAAGGCGTGAAAA

AACTGCTGGATCGCTATTATCTGAGCTTCATTAACGATGTGCTGCACAGCATTAAACTGAAGAACCTGAACAACTAT

ATCAGCCTGTTTCGTAAAAAAACCCGCACCGAAAAAGAAAACAAAGAGCTGGAAAACCTGGAAATCAATCTGCGTAA

AGAAATCGCCAAAGCGTTTAAAGGTAACGAGGGTTATAAAAGCCTGTTCAAGAAAGACATCATCGAAACCATTCTGC

CGGAATTTCTGGATGATAAAGATGAAATTGCCCTGGTGAATAGCTTTAATGGCTTTACCACCGCATTTACCGGCTTT

TTTGATAATCGCGAAAACATGTTCAGCGAAGAAGCAAAAAGCACCAGCATTGCATTTCGCTGCATTAATGAAAATCT

GACCCGCTACATTAGCAACATGGATATCTTTGAAAAAGTGGACGCGATCTTCGATAAACACGAAGTGCAAGAGATCA

AAGAGAAATCCTGAACAGCGATTATGACGTCGAAGATTTTTTTGAAGGCGAGTTCTTTAACTTCGTTCTGACCCAA

GAAGGTATCGACGTTTATAACGCAATTATTGGTGGTTTTGTTACCGAAAGCGGTGAGAAAATCAAAGGCCTGAATGA

ATATATCAACCTGTATAACCAGAAAACCAAACAGAAACTGCCGAAATTCAAACCGCTGTATAAACAGGTTCTGAGCG

ATCGTGAAAGCCTGAGCTTTTATGGTGAAGGTTATACCAGTGATGAAGAGGTTCTGGAAGTTTTTCGTAACACCCTG

AATAAAAACAGCGAGATCTTTAGCAGCATCAAAAAGCTTGAGAAACTGTTCAAAAACTTTGATGAGTATAGCAGCGC

AGGCATCTTTGTTAAAAATGGTCCGGCAATTAGCACCATCAGCAAAGATATTTTTGGCGAATGGAATGTGATCCGCG

ATAAATGGAATGCCGAATATGATGATATCCACCTGAAAAAAAAGGCCGTGGTGACCGAGAAATATGAAGATGATCGT

CGTAAAAGCTTCAAGAAAATTGGTAGCTTTAGCCTGGAACAGCTGCAAGAATATGCAGATGCAGATCTGAGCGTTGT

GGAAAAACTGAAAGAAATCATCATTCAGAAGGTGGACGAGATCTATAAAGTTTATGGTAGCAGCGAAAAACTGTTCG

ATGCAGATTTTGTTCTGGAAAAAAGCCTGAAAAAGAATGATGCCGTTGTGGCCATTATGAAAGATCTGCTGGATAGC

GTTAAGAGCTTCGAGAATTACATCAAAGCCTTTTTTGGTGAGGGCAAAGAAACCAATCGTGATGAAAGTTTCTATGG

CGATTTTGTGCTGGCCTATGATATTCTGCTGAAAGTGGACCATATTTATGATGCCATTCGCAATTATGTTACCCAGA

AACCGTATAGCAAAGACAAGTTCAAACTGTACTTTCAGAACCCCGCAGTTTATGGGTGGTTGGGATAAAGATAAGAA

-continued

ACCGATTATCGTGCCACCATCCTGCGTTATGGTAGTAAATACTATCTGGCCATCATGGACAAAAAATACGCAAAATG

CCTGCAGAAAATCGACAAAGATGATGTGAATGGCAACTATGAAAAAATCAACTACAAACTGCTGCCTGGTCCGAATA

AAATGCTGCCGAAAGTGTTCTTTAGCAAGAAATGGATGGCCTATTATAACCCGAGCGAGGATATTCAAAAGATCTAC

AAAAATGGCACCTTTAAAAAGGGCGACATGTTCAATCTGAACGATTGCCACAAACTGATCGATTTCTTCAAAGATTC

AATTTCGCGTTATCCGAAATGGTCCAATGCCTATGATTTTAACTTTAGCGAAACCGAAAAATACAAAGACATTGCCG

GTTTTTATCGCGAAGTGGAAGAACAGGGCTATAAAGTGAGCTTTGAAAGCGCAAGCAAAAAAGAGGTTGATAAGCTG

GTTGAAGAGGGCAAACTGTATATGTTCCAGATTTACAACAAAGATTTTAGCGACAAAAGCCATGGCACCCCGAATCT

GCATACCATGTACTTTAAACTGCTGTTCGACGAAAATAACCATGGTCAGATTCGTCTGAGCGGTGGTGCCGAACTGT

TTATGCGTCGTGCAAGTCTGAAAAAGAAGAACTGGTTGTTCATCCGGCAAATAGCCCGATTGCAAACAAAAATCCG

GACAATCCGAAAAAAACCACGACACTGAGCTATGATGTGTATAAAGACAAACGTTTTAGCGAGGATCAGTATCTGCT

GCATATCCCGATTGCCATCAATAAATGCCCGAAAAACATCTTTAAGATCAACACCGAAGTTCGCGTGCTGCTGAAAC

ATGATGATAATCCGTATGTGATTGGCATTGATCGTGGTGAACGTAACCTGCTGTATATTGTTGTTGTTGATGGTAAA

GGCAACATCGTGGAACAGTATAGTCTGAACGAAATTATCAACAACTTTAACGGCATCCGCATCAAAACCGACTATCA

TAGCCTGCTGGACAAGAAAGAAAAAGAACGTTTTGAAGCACGTCAGAACTGGACCAGTATTGAAAACATCAAAGAAC

TGAAAGCCGGTTATATTAGCCAGGTGGTTCATAAAATCTGTGAGCTGGTAGAAAAATACGATGCAGTTATTGCACTG

GAAGATCTGAATAGCGGTTTCAAAAATAGCCGTGTGAAAGTCGAAAAACAGGTGTATCAGAAATTCGAGAAAATGCT

GATCGACAAACTGAACTACATGGTCGACAAAAAAAGCAATCCGTGTGCAACCGGTGGTGCACTGAAAGGTTATCAGA

TTACCAACAAATTTGAAAGCTTTAAAAGCATGAGCACCCAGAACGGCTTTATCTTCTATATTCCGGCATGGCTGACC

AGCAAAATTGATCCGAGCACCGGTTTTGTGAACCTGCTGAAAACAAAATATACCTCCATTGCCGACAGCAAGAAGTT

TATTAGCAGCTTTGATCGCATTATGTATGTTCCGGAAGAGGACCTGTTTGAATTCGCACTGGATTACAAAAATTTCA

GCCGTACCGATGCCGACTACATCAAAAAATGGAAACTGTACAGCTATGGTAACCGCATTCGCATTTTTCGCAACCCG

AAGAAAAACAATGTGTTCGATTGGGAAGAAGTTTGTCTGACCAGCGCATATAAAGAACTTTTCAACAAATACGGCAT

CAACTATCAGCAGGGTGATATTCGTGCACTGCTGTGTGAACAGAGCGATAAAGCGTTTTATAGCAGTTTTATGGCAC

TGATGAGCCTGATGCTGCAGATGCGTAATAGCATTACCGGTCGCACCGATGTGGATTTTCTGATTAGTCCGGTGAAA

AATTCCGATGGCATCTTTTATGATAGCCGCAATTACGAAGCACAAGAAATGCAATTCTGCCGAAAAACGCAGATGC

AAATGGTGCATATAACATTGCACGTAAAGTTCTGTGGGCAATTGGCCAGTTTAAGAAAGCAGAAGATGAGAAGCTGG

ACAAAGTGAAAATTGCGATCAGCAATAAAGAGTGGCTGGAATACGCACACGACCAGCGTTAAACATGGAGGCGGAGGG

TCGGAAGCGGCAGCAAAAGGAGGCGGAGGAAGTATGGTGAGCAAAGGTGAAGAGGATAATATGGCCATCATCAAAGA

ATTCATGCGCTTCAAAGTTCATATGGAAGGTAGCGTTAATGGCCACGAATTTGAAATTGAAGGTGAAGGCGAAGGTC

GTCCGTATGAAGGCACCCAGACCGCAAAACTGAAAGTTACCAAAGGTGGTCCGCTGCCGTTTGCATGGGATATTCTG

AGTCCGCAGTTTATGTATGGTAGCAAAGCCTATGTTAAACATCCGGCAGATATCCCGGATTATCTGAAACTGAGCTT

TCCGGAAGGTTTTAAATGGGAACGTGTGATGAATTTTGAAGATGGTGGTGTTGTTACCGTTACACAGGATAGCAGCC

TGCAGGATGGTGAATTTATCTATAAAGTTAAACTGCGTGGCACGAATTTTCCGAGTGATGGTCCGGTTATGCAGAAA

AAAACCATGGGTTGGGAAGCAAGCAGCGAACGTATGTATCCGGAAGATGGCGCACTGAAAGGTGAAATTAAACAGCG

TCTGAAGCTGAAAGATGGCGGTCATTATGATGCAGAAGTTAAAACCACCTACAAAGCCAAAAAACCGGTTCAGCTGC

CTGGTGCATATAACGTTAACATTAAACTGGATATCACCAGCCACAACGAGGATTATACCATTGTTGAACAGTATGAA

CGTGCAGAAGGTCGCCATAGTACCGGTGGTATGGATGAACTGTATAAA (LbCas12a (E795L)-A(EAAAK)$_4$A-mCherry chimera DNA sequence)

SEQ ID NO: 413

ATGAGCAAACTGGAAAAGTTCACCAACTGTTATAGCCTGAGCAAAACCCTGCGTTTTAAAGCAATTCCGGTTGGTAA

AACCCAAGAGAACATTGATAATAAACGCCTGCTGGTCGAAGATGAAAAACGCGCTGAAGATTATAAAGGCGTGAAAA

-continued

```
AACTGCTGGATCGCTATTATCTGAGCTTCATTAACGATGTGCTGCACAGCATTAAACTGAAGAACCTGAACAACTAT
ATCAGCCTGTTTCGTAAAAAAACCCGCACCGAAAAAGAAAACAAAGAGCTGGAAAACCTGGAAATCAATCTGCGTAA
AGAAATCGCCAAAGCGTTTAAAGGTAACGAGGGTTATAAAAGCCTGTTCAAGAAAGACATCATCGAAACCATTCTGC
CGGAATTTCTGGATGATAAAGATGAAATTGCCCTGGTGAATAGCTTTAATGGCTTTACCACCGCATTTACCGGCTTT
TTTGATAATCGCGAAAACATGTTCAGCGAAGAAGCAAAAAGCACCAGCATTGCATTTCGCTGCATTAATGAAAATCT
GACCCGCTACATTAGCAACATGGATATCTTTGAAAAAGTGGACGCGATCTTCGATAAACACGAAGTGCAAGAGATCA
AAGAGAAAATCCTGAACAGCGATTATGACGTCGAAGATTTTTTTGAAGGCGAGTTCTTTAACTTCGTTCTGACCCAA
GAAGGTATCGACGTTTATAACGCAATTATTGGTGGTTTTGTTACCGAAAGCGGTGAGAAAATCAAAGGCCTGAATGA
ATATATCAACCTGTATAACCAGAAAACCAAACAGAAACTGCCGAAATTCAAACCGCTGTATAAACAGGTTCTGAGCG
ATCGTGAAAGCCTGAGCTTTTATGGTGAAGGTTATACCAGTGATGAAGAGGTTCTGGAAGTTTTTCGTAACACCCTG
AATAAAAACAGCGAGATCTTTAGCAGCATCAAAAAGCTTGAGAAACTGTTCAAAAACTTTGATGAGTATAGCAGCGC
AGGCATCTTTGTTAAAAATGGTCCGGCAATTAGCACCATCAGCAAAGATATTTTTGGCAATGGAATGTGATCCGCG
ATAAATGGAATGCCGAATATGATGATATCCACCTGAAAAAAAAGGCCGTGGTGACCGAGAAATATGAAGATGATCGT
CGTAAAAGCTTCAAGAAAATTGGTAGCTTTAGCCTGGAACAGCTGCAAGAATATGCAGATGCAGATCTGAGCGTTGT
GGAAAAACTGAAAGAAATCATCATTCAGAAGGTGGACGAGATCTATAAAGTTTATGGTAGCAGCGAAAAACTGTTCG
ATGCAGATTTTGTTCTGGAAAAAAGCCTGAAAAAGAATGATGCCGTTGTGGCCATTATGAAAGATCTGCTGGATAGC
GTTAAGAGCTTCGAGAATTACATCAAAGCCTTTTTTGGTGAGGGCAAAGAAACCAATCGTGATGAAAGTTTCTATGG
CGATTTTGTGCTGGCCTATGATATTCTGCTGAAAGTGGACCATATTTATGATGCCATTCGCAATTATGTTACCCAGA
AACCGTATAGCAAAGACAAGTTCAAACTGTACTTTCAGAACCCGCAGTTTATGGGTGGTTGGGATAAAGATAAAGAA
ACCGATTATCGTGCCACCATCCTGCGTTATGGTAGTAAATACTATCTGGCCATCATGGACAAAAAATACGCAAAATG
CCTGCAGAAAATCGACAAAGATGATGTGAATGGCAACTATGAAAAAATCAACTACAAACTGCTGCCTGGTCCGAATA
AAATGCTGCCGAAAGTGTTCTTTAGCAAGAAATGGATGGCCTATTATAACCCGAGCGAGGATATTCAAAAGATCTAC
AAAAATGGCACCTTTAAAAAGGGCGACATGTTCAATCTGAACGATTGCCACAAACTGATCGATTTCTTCAAAGATTC
AATTTCGCGTTATCCGAAATGGTCCAATGCCTATGATTTTAACTTTAGCGAAACCGAAAAATACAAAGACATTGCCG
GTTTTTATCGCGAAGTGGAAGAACAGGGCTATAAAGTGAGCTTTGAAAGCGCAAGCAAAAAAGAGGTTGATAAGCTG
GTTGAAGAGGGCAAACTGTATATGTTCCAGATTTACAACAAAGATTTTAGCGACAAAAGCCATGGCACCCCGAATCT
GCATACCATGTACTTTAAACTGCTGTTCGACGAAAATAACCATGGTCAGATTCGTCTGAGCGGTGGTGCCGAACTGT
TTATGCGTCGTGCAAGTCTGAAAAAAGAAGAACTGGTTGTTCATCCGGCAAATAGCCCGATTGCAAACAAAAATCCG
GACAATCCGAAAAAAACCACGACACTGAGCTATGATGTGTATAAAGACAAACGTTTTAGCGAGGATCAGTATCTGCT
GCATATCCCGATTGCCATCAATAAATGCCCGAAAAACATCTTTAAGATCAACACCGAAGTTCGCGTGCTGCTGAAAC
ATGATGATAATCCGTATGTGATTGGCATTGATCGTGGTGAACGTAACCTGCTGTATATTGTTGTTGTTGATGGTAAA
GGCAACATCGTGGAACAGTATAGTCTGAACGAAATTATCAACAACTTTAACGGCATCCGCATCAAAACCGACTATCA
TAGCCTGCTGGACAAGAAAGAAAAGAACGTTTTGAAGCACGTCAGAACTGGACCAGTATTGAAAACATCAAAGAAC
TGAAAGCCGGTTATATTAGCCAGGTGGTTCATAAAATCTGTGAGCTGGTAGAAAAATACGATGCAGTTATTGCACTG
GAAGATCTGAATAGCGGTTTCAAAAATAGCCGTGTGAAAGTCGAAAAACAGGTGTATCAGAATTCGAGAAATGCT
GATCGACAAACTGAACTACATGGTCGACAAAAAAGCAATCCGTGTGCAACCGGTGGTGCACTGAAAGGTTATCAGA
TTACCAACAAATTTGAAAGCTTTAAAAGCATGAGCACCCAGAACGGCTTTATCTTCTATATTCCGGCATGGCTGACC
AGCAAAATTGATCCGAGCACCGGTTTTGTGAACCTGCTGAAAACAAAATATACCTCCATTGCCGACAGCAAGAAGTT
TATTAGCAGCTTTGATCGCATTATGTATGTTCCGGAAGAGGACCTGTTTGAATTCGCACTGGATTACAAAAATTTCA
GCCGTACCGATGCCGACTACATCAAAAAATGGAAACTGTACAGCTATGGTAACCGCATTCGCATTTTTCGCAACCCG
AAGAAAAACAATGTGTTCGATTGGGAAGAAGTTTGTCTGACCAGCGCATATAAAGAACTTTTCAACAAATACGGCAT
```

```
CAACTATCAGCAGGGTGATATTCGTGCACTGCTGTGTGAACAGAGCGATAAAGCGTTTTATAGCAGTTTTATGGCAC

TGATGAGCCTGATGCTGCAGATGCGTAATAGCATTACCGGTCGCACCGATGTGGATTTTCTGATTAGTCCGGTGAAA

AATTCCGATGGCATCTTTTATGATAGCCGCAATTACGAAGCACAAGAAAATGCAATTCTGCCGAAAAACGCAGATGC

AAATGGTGCATATAACATTGCACGTAAAGTTCTGTGGGCAATTGGCCAGTTTAAGAAAGCAGAAGATGAGAAGCTGG

ACAAAGTGAAAATTGCGATCAGCAATAAAGAGTGGCTGGAATACGCACAGACCAGCGTTAAACATGCTGAGGCCGCA

GCAAAAGAGGCTGCCGCTAAGGAGGCTGCTGCAAAAGAAGCAGCAGCGAAAGCTATGGTGAGCAAAGGTGAAGAGGA

TAATATGGCCATCATCAAAGAATTCATGCGCTTCAAAGTTCATATGGAAGGTAGCGTTAATGGCCACGAATTTGAAA

TTGAAGGTGAAGGCGAAGGTCGTCCGTATGAAGGCACCCAGACCGCAAAACTGAAAGTTACCAAAGGTGGTCCGCTG

CCGTTTGCATGGGATATTCTGAGTCCGCAGTTTATGTATGGTAGCAAAGCCTATGTTAAACATCCGGCAGATATCCC

GGATTATCTGAAACTGAGCTTTCCGGAAGGTTTTAAATGGGAACGTGTGATGAATTTTGAAGATGGTGGTGTTGTTA

CCGTTACACAGGATAGCAGCCTGCAGGATGGTGAATTTATCTATAAAGTTAAACTGCGTGGCACGAATTTTCCGAGT

GATGGTCCGGTTATGCAGAAAAAAACCATGGGTTGGGAAGCAAGCAGCGAACGTATGTATCCGGAAGATGGCGCACT

GAAAGGTGAAATTAAACAGCGTCTGAAGCTGAAAGATGGCGGTCATTATGATGCAGAAGTTAAAACCACCTACAAAG

CCAAAAAACCGGTTCAGCTGCCTGGTGCATATAACGTTAACATTAAACTGGATATCACCAGCCACAACGAGGATTAT

ACCATTGTTGAACAGTATGAACGTGCAGAAGGTCGCCATAGTACCGGTGGTATGGATGAACTGTATAAA
```

(LbCas12a (E795L)-A(EAAAK)₄ALEA(EAAAK)₄A-mCherry chimera DNA sequence)
SEQ ID NO: 414

```
ATGAGCAAACTGGAAAAGTTCACCAACTGTTATAGCCTGAGCAAAACCCTGCGTTTTAAAGCAATTCCGGTTGGTAA

AACCCAAGAGAACATTGATAATAAACGCCTGCTGGTCGAAGATGAAAAACGCGCTGAAGATTATAAAGGCGTGAAAA

AACTGCTGGATCGCTATTATCTGAGCTTCATTAACGATGTGCTGCACAGCATTAAACTGAAGAACCTGAACAACTAT

ATCAGCCTGTTTCGTAAAAAAACCCGCACCGAAAAGAAAACAAAGAGCTGGAAAACCTGGAAATCAATCTGCGTAA

AGAAATCGCCAAAGCGTTTAAAGGTAACGAGGGTTATAAAAGCCTGTTCAAGAAAGACATCATCGAAACCATTCTGC

CGGAATTTCTGGATGATAAAGATGAAATTGCCCTGGTGAATAGCTTTAATGGCTTTACCACCGCATTTACCGGCTTT

TTTGATAATCGCGAAAACATGTTCAGCGAAGAAGCAAAAAGCACCAGCATTGCATTTCGCTGCATTAATGAAAATCT

GACCCGCTACATTAGCAACATGGATATCTTTGAAAAAGTGGACGCGATCTTCGATAAACACGAAGTGCAAGAGATCA

AAGAGAAAATCCTGAACAGCGATTATGACGTCGAAGATTTTTTTGAAGGCGAGTTCTTTAACTTCGTTCTGACCCAA

GAAGGTATCGACGTTTATAACGCAATTATTGGTGGTTTTGTTACCGAAAGCGGTGAGAAAATCAAAGGCCTGAATGA

ATATATCAACCTGTATAACCAGAAAACCAAACAGAAACTGCCGAAATTCAAACCGCTGTATAAACAGGTTCTGAGCG

ATCGTGAAAGCCTGAGCTTTTATGGTGAAGGTTATACCAGTGATGAAGAGGTTCTGGAAGTTTTTCGTAACACCCTG

AATAAAAACAGCGAGATCTTTAGCAGCATCAAAAAGCTTGAGAAACTGTTCAAAAACTTTGATGAGTATAGCAGCGC

AGGCATCTTTGTTAAAAATGGTCCGGCAATTAGCACCATCAGCAAAGATATTTTTGGCGAATGGAATGTGATCCGCG

ATAAATGGAATGCCGAATATGATGATATCCACCTGAAAAAAAGGCCGTGGTGACCGAGAAATATGAAGATGATCGT

CGTAAAAGCTTCAAGAAAATTGGTAGCTTTAGCCTGGAACAGCTGCAAGAATATGCAGATGCAGATCTGAGCGTTGT

GGAAAAACTGAAAGAAATCATCATTCAGAAGGTGGACGAGATCTATAAAGTTTATGGTAGCAGCGAAAAACTGTTCG

ATGCAGATTTTGTTCTGGAAAAAAGCCTGAAAAAGAATGATGCCGTTGTGGCCATTATGAAAGATCTGCTGGATAGC

GTTAAGAGCTTCGAGAATTACATCAAAGCCTTTTTTGGTGAGGGCAAAGAAACCAATCGTGATGAAAGTTTCTATGG

CGATTTTGTGCTGGCCTATGATATTCTGCTGAAAGTGGACCATATTTATGATGCCATTCGCAATTATGTTACCCAGA

AACCGTATAGCAAAGACAAGTTCAAACTGTACTTTCAGAACCCGCAGTTTATGGGTGGTTGGGATAAAGATAAAGAA

ACCGATTATCGTGCCACCATCCTGCGTTATGGTAGTAAATACTATCTGGCCATCATGGACAAAAAATACGCAAAATG

CCTGCAGAAAATCGACAAAGATGATGTGAATGGCAACTATGAAAAAATCAACTACAAACTGCTGCCTGGTCCGAATA

AAATGCTGCCGAAAGTGTTCTTTAGCAAGAAATGGATGGCCTATTATAACCCGAGCGAGGATATTCAAAAGATCTAC
```

-continued

AAAAATGGCACCTTTAAAAAGGGCGACATGTTCAATCTGAACGATTGCCACAAACTGATCGATTTCTTCAAAGATTC

AATTTCGCGTTATCCGAAATGGTCCAATGCCTATGATTTTAACTTTAGCGAAACCGAAAAATACAAAGACATTGCCG

GTTTTTATCGCGAAGTGGAAGAACAGGGCTATAAAGTGAGCTTTGAAAGCGCAAGCAAAAAGAGGTTGATAAGCTG

GTTGAAGAGGGCAAACTGTATATGTTCCAGATTTACAACAAAGATTTTAGCGACAAAAGCCATGGCACCCCGAATCT

GCATACCATGTACTTTAAACTGCTGTTCGACGAAAATAACCATGGTCAGATTCGTCTGAGCGGTGGTGCCGAACTGT

TTATGCGTCGTGCAAGTCTGAAAAAAGAAGAACTGGTTGTTCATCCGGCAAATAGCCCGATTGCAAACAAAAATCCG

GACAATCCGAAAAAAACCACGACACTGAGCTATGATGTGTATAAAGACAAACGTTTTAGCGAGGATCAGTATCTGCT

GCATATCCCGATTGCCATCAATAAATGCCCGAAAAACATCTTTAAGATCAACACCGAAGTTCGCGTGCTGCTGAAAC

ATGATGATAATCCGTATGTGATTGGCATTGATCGTGGTGAACGTAACCTGCTGTATATTGTTGTTGATGGTAAA

GGCAACATCGTGGAACAGTATAGTCTGAACGAAATTATCAACAACTTTAACGGCATCCGCATCAAAACCGACTATCA

TAGCCTGCTGGACAAGAAGAAAAAGAACGTTTTGAAGCACGTCAGAACTGGACCAGTATTGAAAACATCAAAGAAC

TGAAAGCCGGTTATATTAGCCAGGTGGTTCATAAAATCTGTGAGCTGGTAGAAAAATACGATGCAGTTATTGCACTG

GAAGATCTGAATAGCGGTTTCAAAAATAGCCGTGTGAAAGTCGAAAAACAGGTGTATCAGAAATTCGAGAAAATGCT

GATCGACAAACTGAACTACATGGTCGACAAAAAAAGCAATCCGTGTGCAACCGGTGGTGCACTGAAAGGTTATCAGA

TTACCAACAAATTTGAAAGCTTTAAAAGCATGAGCACCCAGAACGGCTTTATCTTCTATATTCCGGCATGGCTGACC

AGCAAAATTGATCCGAGCACCGGTTTTGTGAACCTGCTGAAAACAAAATATACCTCCATTGCCGACAGCAAGAAGTT

TATTAGCAGCTTTGATCGCATTATGTATGTTCCGGAAGAGGACCTGTTTGAATTCGCACTGGATTACAAAAATTTCA

GCCGTACCGATGCCGACTACATCAAAAAATGGAAACTGTACAGCTATGGTAACCGCATTCGCATTTTTCGCAACCCG

AAGAAAAACAATGTGTTCGATTGGGAAGAAGTTTGTCTGACCAGCGCATATAAAGAACTTTTCAACAAATACGGCAT

CAACTATCAGCAGGGTGATATTCGTGCACTGCTGTGTGAACAGAGCGATAAAGCGTTTTATAGCAGTTTTATGGCAC

TGATGAGCCTGATGCTGCAGATGCGTAATAGCATTACCGGTCGCACCGATGTGGATTTTCTGATTAGTCCGGTGAAA

AATTCCGATGGCATCTTTTATGATAGCCGCAATTACGAAGCACAAGAAAATGCAATTCTGCCGAAAAACGCAGATGC

AAATGGTGCATATAACATTGCACGTAAAGTTCTGTGGGCAATTGGCCAGTTTAAGAAAGCAGAAGATGAGAAGCTGG

ACAAAGTGAAAATTGCGATCAGCAATAAAGAGTGGCTGGAATACGCACAGACCAGCGTTAAACATGCCGAAGCAGCA

GCCAAAGAAGCTGCCGCAAAGGAGGCGGCAGCTAAAGAAGCGGCCGCTAAGGCATTGGAAGCGGAGGCGGCTGCCAA

GGAGGCTGCGGCGAAAGAAGCTGCGGCCAAAGAAGCGGCTGCAAAAGCGATGGTGAGCAAAGGTGAAGAGGATAATA

TGGCCATCATCAAAGAATTCATGCGCTTCAAAGTTCATATGGAAGGTAGCGTTAATGGCCACGAATTTGAAATTGAA

GGTGAAGGCGAAGGTCGTCCGTATGAAGGCACCCAGACCGCAAAACTGAAAGTTACCAAAGGTGGTCCGCTGCCGTT

TGCATGGGATATTCTGAGTCCGCAGTTTATGTATGGTAGCAAAGCCTATGTTAAACATCCGGCAGATATCCCGGATT

ATCTGAAACTGAGCTTTCCGGAAGGTTTTAAATGGGAACGTGTGATGAATTTTGAAGATGGTGGTGTTGTTACCGTT

ACACAGGATAGCAGCCTGCAGGATGGTGAATTTATCTATAAAGTTAAACTGCGTGGCACGAATTTTCCGAGTGATGG

TCCGGTTATGCAGAAAAAAACCATGGGTTGGGAAGCAAGCAGCGAACGTATGTATCCGGAAGATGGCGCACTGAAAG

GTGAAATTAAACAGCGTCTGAAGCTGAAAGATGGCGGTCATTATGATGCAGAAGTTAAAACCACCTACAAAGCCAAA

AAACCGGTTCAGCTGCCTGGTGCATATAACGTTAACATTAAACTGGATATCACCAGCCACAACGAGGATTATACCAT

TGTTGAACAGTATGAACGTGCAGAAGGTCGCCATAGTACCGGTGGTATGGATGAACTGTATAAA (LbCas12a (E795L)-LEA(EAAAK)$_4$ALEA(EAAAK)$_4$ALE-mCherry chimera DNA sequence)
SEQ ID NO: 415

ATGAGCAAACTGGAAAAGTTCACCAACTGTTATAGCCTGAGCAAAACCCTGCGTTTTAAAGCAATTCCGGTTGGTAA

AACCCAAGAGAACATTGATAATAAACGCCTGCTGGTCGAAGATGAAAAACGCGCTGAAGATTATAAAGGCGTGAAAA

AACTGCTGGATCGCTATTATCTGAGCTTCATTAACGATGTGCTGCACAGCATTAAACTGAAGAACCTGAACAACTAT

ATCAGCCTGTTTCGTAAAAAAACCCGCACCGAAAAGAAAACAAAGAGCTGGAAAACCTGGAAATCAATCTGCGTAA

AGAAATCGCCAAAGCGTTTAAAGGTAACGAGGGTTATAAAAGCCTGTTCAAGAAAGACATCATCGAAACCATTCTGC

-continued

```
CGGAATTTCTGGATGATAAAGATGAAATTGCCCTGGTGAATAGCTTTAATGGCTTTACCACCGCATTTACCGGCTTT
TTTGATAATCGCGAAAACATGTTCAGCGAAGAAGCAAAAAGCACCAGCATTGCATTTCGCTGCATTAATGAAAATCT
GACCCGCTACATTAGCAACATGGATATCTTTGAAAAAGTGGACGCGATCTTCGATAAACACGAAGTGCAAGAGATCA
AAGAGAAAATCCTGAACAGCGATTATGACGTCGAAGATTTTTTTGAAGGCGAGTTCTTTAACTTCGTTCTGACCCAA
GAAGGTATCGACGTTTATAACGCAATTATTGGTGGTTTTGTTACCGAAAGCGGTGAGAAAATCAAAGGCCTGAATGA
ATATATCAACCTGTATAACCAGAAAACCAAACAGAAACTGCCGAAATTCAAACCGCTGTATAAACAGGTTCTGAGCG
ATCGTGAAAGCCTGAGCTTTTATGGTGAAGGTTATACCAGTGATGAAGAGGTTCTGGAAGTTTTTCGTAACACCCTG
AATAAAAACAGCGAGATCTTTAGCAGCATCAAAAAGCTTGAGAAACTGTTCAAAAACTTTGATGAGTATAGCAGCGC
AGGCATCTTTGTTAAAAATGGTCCGGCAATTAGCACCATCAGCAAAGATATTTTTGGCGAATGGAATGTGATCCGCG
ATAAATGGAATGCCGAATATGATGATATCCACCTGAAAAAAAAGGCCGTGGTGACCGAGAAATATGAAGATGATCGT
CGTAAAAGCTTCAAGAAAATTGGTAGCTTTAGCCTGGAACAGCTGCAAGAATATGCAGATGCAGATCTGAGCGTTGT
GGAAAAACTGAAAGAAATCATCATTCAGAAGGTGGACGAGATCTATAAAGTTTATGGTAGCAGCGAAAAACTGTTCG
ATGCAGATTTTGTTCTGGAAAAAAGCCTGAAAAAGAATGATGCCGTTGTGGCCATTATGAAAGATCTGCTGGATAGC
GTTAAGAGCTTCGAGAATTACATCAAAGCCTTTTTTGGTGAGGGCAAAGAAACCAATCGTGATGAAAGTTTCTATGG
CGATTTTGTGCTGGCCTATGATATTCTGCTGAAAGTGGACCATATTTATGATGCCATTCGCAATTATGTTACCCAGA
AACCGTATAGCAAAGACAAGTTCAAACTGTACTTTCAGAACCCGCAGTTTATGGGTGGTTGGGATAAAGATAAAGAA
ACCGATTATCGTGCCACCATCCTGCGTTATGGTAGTAAATACTATCTGGCCATCATGGACAAAAAATACGCAAAATG
CCTGCAGAAAATCGACAAAGATGATGTGAATGGCAACTATGAAAAATCAACTACAAACTGCTGCCTGGTCCGAATA
AAATGCTGCCGAAAGTGTTCTTTAGCAAGAAATGGATGGCCTATTATAACCCGAGCGAGGATATTCAAAAGATCTAC
AAAAATGGCACCTTTAAAAAGGGCGACATGTTCAATCTGAACGATTGCCACAAACTGATCGATTTCTTCAAAGATTC
AATTTCGCGTTATCCGAAATGGTCCAATGCCTATGATTTTAACTTTAGCGAAACCGAAAAATACAAAGACATTGCCG
GTTTTTATCGCGAAGTGGAAGAACAGGGCTATAAAGTGAGCTTTGAAAGCGCAAGCAAAAAAGAGGTTGATAAGCTG
GTTGAAGAGGGCAAACTGTATATGTTCCAGATTTACAACAAAGATTTTAGCGACAAAAGCCATGGCACCCCGAATCT
GCATACCATGTACTTTAAACTGCTGTTCGACGAAAATAACCATGGTCAGATTCGTCTGAGCGGTGGTGCCGAACTGT
TTATGCGTCGTGCAAGTCTGAAAAAAGAAGAACTGGTTGTTCATCCGGCAAATAGCCCGATTGCAAACAAAAATCCG
GACAATCCGAAAAAACCACGACACTGAGCTATGATGTGTATAAAGACAAACGTTTTAGCGAGGATCAGTATCTGCT
GCATATCCCGATTGCCATCAATAAATGCCCGAAAAACATCTTTAAGATCAACACCGAAGTTCGCGTGCTGCTGAAAC
ATGATGATAATCCGTATGTGATTGGCATTGATCGTGGTGAACGTAACCTGCTGTATATTGTTGTTGTTGATGGTAAA
GGCAACATCGTGGAACAGTATAGTCTGAACGAAATTATCAACAACTTTAACGGCATCCGCATCAAAACCGACTATCA
TAGCCTGCTGGACAAGAAAGAAAAAGAACGTTTTGAAGCACGTCAGAACTGGACCAGTATTGAAAACATCAAAGAAC
TGAAAGCCGGTTATATTAGCCAGGTGGTTCATAAAATCTGTGAGCTGGTAGAAAAATACGATGCAGTTATTGCACTG
GAAGATCTGAATAGCGGTTTCAAAAATAGCCGTGTGAAAGTCGAAAAACAGGTGTATCAGAAATTCGAGAAAATGCT
GATCGACAAACTGAACTACATGGTCGACAAAAAAGCAATCCGTGTGCAACCGGTGGTGCACTGAAAGGTTATCAGA
TTACCAACAAATTTGAAAGCTTTAAAAGCATGAGCACCCAGAACGGCTTTATCTTCTATATTCCGGCATGGCTGACC
AGCAAAATTGATCCGAGCACCGGTTTTGTGAACCTGCTGAAAACAAAATATACCTCCATTGCCGACAGCAAGAAGTT
TATTAGCAGCTTTGATCGCATTATGTATGTTCCGGAAGAGGACCTGTTTGAATTCGCACTGGATTACAAAAATTTCA
GCCGTACCGATGCCGACTACATCAAAAAATGGAAACTGTACAGCTATGGTAACCGCATTCGCATTTTTCGCAACCCG
AAGAAAAACAATGTGTTCGATTGGGAAGAAGTTTGTCTGACCAGCGCATATAAAGAACTTTTCAACAAATACGGCAT
CAACTATCAGCAGGGTGATATTCGTGCACTGCTGTGTGAACAGAGCGATAAAGCGTTTTATAGCAGTTTTATGGCAC
TGATGAGCCTGATGCTGCAGATGCGTAATAGCATTACCGGTCGCACCGATGTGGATTTTCTGATTAGTCCGGTGAAA
```

AATTCCGATGGCATCTTTTATGATAGCCGCAATTACGAAGCACAAGAAAATGCAATTCTGCCGAAAAACGCAGATGC

AAATGGTGCATATAACATTGCACGTAAAGTTCTGTGGGCAATTGGCCAGTTTAAGAAAGCAGAAGATGAGAAGCTGG

ACAAAGTGAAAATTGCGATCAGCAATAAAGAGTGGCTGGAATACGCACAGACCAGCGTTAAACATTTAGAGGCTGAG

GCTGCTGCCAAGGAGGCTGCTGCGAAGGAAGCTGCAGCTAAAGAGGCAGCGGCCAAAGCACTTGAGGCCGAAGCCGC

CGCGAAAGAAGCCGCTGCTAAGGAGGCAGCCGCCAAAGAAGCGGCAGCTAAAGCATTAGAAATGGTGAGCAAAGGTG

AAGAGGATAATATGGCCATCATCAAAGAATTCATGCGCTTCAAAGTTCATATGGAAGGTAGCGTTAATGGCCACGAA

TTTGAAATTGAAGGTGAAGGCGAAGGTCGTCCGTATGAAGGCACCCAGACCGCAAAACTGAAAGTTACCAAAGGTGG

TCCGCTGCCGTTTGCATGGGATATTCTGAGTCCGCAGTTTATGTATGGTAGCAAAGCCTATGTTAAACATCCGGCAG

ATATCCCGGATTATCTGAAACTGAGCTTTCCGGAAGGTTTTAAATGGGAACGTGTGATGAATTTTGAAGATGGTGGT

GTTGTTACCGTTACACAGGATAGCAGCCTGCAGGATGGTGAATTTATCTATAAAGTTAAACTGCGTGGCACGAATTT

TCCGAGTGATGGTCCGGTTATGCAGAAAAAAACCATGGGTTGGGAAGCAAGCAGCGAACGTATGTATCCGGAAGATG

GCGCACTGAAAGGTGAAATTAAACAGCGTCTGAAGCTGAAAGATGGCGGTCATTATGATGCAGAAGTTAAAACCACC

TACAAAGCCAAAAAACCGGTTCAGCTGCCTGGTGCATATAACGTTAACATTAAACTGGATATCACCAGCCACAACGA

GGATTATACCATTGTTGAACAGTATGAACGTGCAGAAGGTCGCCATAGTACCGGTGGTATGGATGAACTGTATAAA (LbCas12a (E795L)-APA-mCherry chimera DNA sequence)

SEQ ID NO: 416

ATGAGCAAACTGGAAAAGTTCACCAACTGTTATAGCCTGAGCAAAACCCTGCGTTTTAAAGCAATTCCGGTTGGTAA

AACCCAAGAGAACATTGATAATAAACGCCTGCTGGTCGAAGATGAAAAACGCGCTGAAGATTATAAAGGCGTGAAAA

AACTGCTGGATCGCTATTATCTGAGCTTCATTAACGATGTGCTGCACAGCATTAAACTGAAGAACCTGAACAACTAT

ATCAGCCTGTTTCGTAAAAAAACCCGCACCGAAAAAGAAAACAAAGAGCTGGAAAACCTGGAAATCAATCTGCGTAA

AGAAATCGCCAAAGCGTTTAAAGGTAACGAGGGTTATAAAAGCCTGTTCAAGAAAGACATCATCGAAACCATTCTGC

CGGAATTTCTGGATGATAAAGATGAAATTGCCCTGGTGAATAGCTTTAATGGCTTTACCACCGCATTTACCGGCTTT

TTTGATAATCGCGAAAACATGTTCAGCGAAGAAGCAAAAAGCACCAGCATTGCATTTCGCTGCATTAATGAAAATCT

GACCCGCTACATTAGCAACATGGATATCTTTGAAAAAGTGGACGCGATCTTCGATAAACACGAAGTGCAAGAGATCA

AAGAGAAAATCCTGAACAGCGATTATGACGTCGAAGATTTTTTTGAAGGCGAGTTCTTTAACTTCGTTCTGACCCAA

GAAGGTATCGACGTTTATAACGCAATTATTGGTGGTTTTGTTACCGAAAGCGGTGAGAAAATCAAAGGCCTGAATGA

ATATATCAACCTGTATAACCAGAAAACCAAACAGAAACTGCCGAAATTCAAACCGCTGTATAAACAGGTTCTGAGCG

ATCGTGAAAGCCTGAGCTTTTATGGTGAAGGTTATACCAGTGATGAAGAGGTTCTGGAAGTTTTTCGTAACACCCTG

AATAAAAACAGCGAGATCTTTAGCAGCATCAAAAAGCTTGAGAAACTGTTCAAAAACTTTGATGAGTATAGCAGCGC

AGGCATCTTTGTTAAAAATGGTCCGGCAATTAGCACCATCAGCAAAGATATTTTTGGCGAATGGAATGTGATCCGCG

ATAAATGGAATGCCGAATATGATGATATCCACCTGAAAAAAAAGGCCGTGGTGACCGAGAAATATGAAGATGATCGT

CGTAAAAGCTTCAAGAAAATTGGTAGCTTTAGCCTGGAACAGCTGCAAGAATATGCAGATGCAGATCTGAGCGTTGT

GGAAAAAACTGAAAGAAATCATCATTCAGAAGGTGGACGAGATCTATAAAGTTTATGGTAGCAGCGAAAAACTGTTCG

ATGCAGATTTTGTTCTGGAAAAAAGCCTGAAAAAGAATGATGCCGTTGTGGCCATTATGAAAGATCTGCTGGATAGC

GTTAAGAGCTTCGAGAATTACATCAAAGCCTTTTTTGGTGAGGGCAAAGAAACCAATCGTGATGAAAGTTTCTATGG

CGATTTTGTGCTGGCCTATGATATTCTGCTGAAAGTGGACCATATTTATGATGCCATTCGCAATTATGTTACCCAGA

AACCGTATAGCAAAGACAAGTTCAAACTGTACTTTCAGAACCCGCAGTTTATGGGTGGTTGGGATAAAGATAAAGAA

ACCGATTATCGTGCCACCATCCTGCGTTATGGTAGTAAATACTATCTGGCCATCATGGACAAAAAATACGCAAAATG

CCTGCAGAAAATCGACAAAGATGATGTGAATGGCAACTATGAAAAAATCAACTACAAACTGCTGCCTGGTCCGAATA

AAATGCTGCCGAAAGTGTTCTTTAGCAAGAAATGGATGGCCTATTATAACCCGAGCGAGGATATTCAAAAGATCTAC

AAAAATGGCACCTTTAAAAAGGGCGACATGTTCAATCTGAACGATTGCCACAAACTGATCGATTTCTTCAAAGATTC

AATTTCGCGTTATCCGAAATGGTCCAATGCCTATGATTTTAACTTTAGCGAAACCGAAAAATACAAAGACATTGCCG

```
-continued
GTTTTTATCGCGAAGTGGAAGAACAGGGCTATAAAGTGAGCTTTGAAAGCGCAAGCAAAAAGAGGTTGATAAGCTG

GTTGAAGAGGGCAAACTGTATATGTTCCAGATTTACAACAAAGATTTTAGCGACAAAAGCCATGGCACCCCGAATCT

GCATACCATGTACTTTAAACTGCTGTTCGACGAAAATAACCATGGTCAGATTCGTCTGAGCGGTGGTGCCGAACTGT

TTATGCGTCGTGCAAGTCTGAAAAAAGAAGAACTGGTTGTTCATCCGGCAAATAGCCCGATTGCAAACAAAAATCCG

GACAATCCGAAAAAAACCACGACACTGAGCTATGATGTGTATAAAGACAAACGTTTTAGCGAGGATCAGTATCTGCT

GCATATCCCGATTGCCATCAATAAATGCCCGAAAAACATCTTTAAGATCAACACCGAAGTTCGCGTGCTGCTGAAAC

ATGATGATAATCCGTATGTGATTGGCATTGATCGTGGTGAACGTAACCTGCTGTATATTGTTGTTGATGGTAAA

GGCAACATCGTGGAACAGTATAGTCTGAACGAAATTATCAACAACTTTAACGGCATCCGCATCAAAACCGACTATCA

TAGCCTGCTGGACAAGAAGAAAAAGAACGTTTTGAAGCACGTCAGAACTGGACCAGTATTGAAAACATCAAAGAAC

TGAAAGCCGGTTATATTAGCCAGGTGGTTCATAAAATCTGTGAGCTGGTAGAAAAATACGATGCAGTTATTGCACTG

GAAGATCTGAATAGCGGTTTCAAAAATAGCCGTGTGAAAGTCGAAAAACAGGTGTATCAGAAATTCGAGAAAATGCT

GATCGACAAACTGAACTACATGGTCGACAAAAAAAGCAATCCGTGTGCAACCGGTGGTGCACTGAAAGGTTATCAGA

TTACCAACAAATTTGAAAGCTTTAAAAGCATGAGCACCCAGAACGGCTTTATCTTCTATATTCCGGCATGGCTGACC

AGCAAAATTGATCCGAGCACCGGTTTTGTGAACCTGCTGAAAACAAAATATACCTCCATTGCCGACAGCAAGAAGTT

TATTAGCAGCTTTGATCGCATTATGTATGTTCCGGAAGAGGACCTGTTTGAATTCGCACTGGATTACAAAAATTTCA

GCCGTACCGATGCCGACTACATCAAAAAATGGAAACTGTACAGCTATGGTAACCGCATTCGCATTTTTCGCAACCCG

AAGAAAAACAATGTGTTCGATTGGGAAGAAGTTTGTCTGACCAGCGCATATAAAGAACTTTTCAACAAATACGGCAT

CAACTATCAGCAGGGTGATATTCGTGCACTGCTGTGTGAACAGAGCGATAAAGCGTTTTATAGCAGTTTTATGGCAC

TGATGAGCCTGATGCTGCAGATGCGTAATAGCATTACCGGTCGCACCGATGTGGATTTTCTGATTAGTCCGGTGAAA

AATTCCGATGGCATCTTTTATGATAGCCGCAATTACGAAGCACAAGAAAATGCAATTCTGCCGAAAAACGCAGATGC

AAATGGTGCATATAACATTGCACGTAAAGTTCTGTGGGCAATTGGCCAGTTTAAGAAAGCAGAAGATGAGAAGCTGG

ACAAAGTGAAAATTGCGATCAGCAATAAAGAGTGGCTGGAATACGCACAGACCAGCGTTAAACATGCACCTGCGATG

GTGAGCAAAGGTGAAGAGGATAATATGGCCATCATCAAAGAATTCATGCGCTTCAAAGTTCATATGGAAGGTAGCGT

TAATGGCCACGAATTTGAAATTGAAGGTGAAGGCGAAGGTCGTCCGTATGAAGGCACCCAGACCGCAAAACTGAAAG

TTACCAAAGGTGGTCCGCTGCCGTTTGCATGGGATATTCTGAGTCCGCAGTTTATGTATGGTAGCAAAGCCTATGTT

AAACATCCGGCAGATATCCCCGGATTATCTGAAACTGAGCTTTCCGGAAGGTTTTAAATGGGAACGTGTGATGAATTT

TGAAGATGGTGGTGTTGTTACCGTTACACAGGATAGCAGCCTGCAGGATGGTGAATTTATCTATAAAGTTAAACTGC

GTGGCACGAATTTTCCGAGTGATGGTCCGGTTATGCAGAAAAAAACCATGGGTTGGGAAGCAAGCAGCGAACGTATG

TATCCGGAAGATGGCGCACTGAAAGGTGAAATTAAACAGCGTCTGAAGCTGAAAGATGGCGGTCATTATGATGCAGA

AGTTAAAACCACCTACAAAGCCAAAAAACCGGTTCAGCTGCCTGGTGCATATAACGTTAACATTAAACTGGATATCA

CCAGCCACAACGAGGATTATACCATTGTTGAACAGTATGAACGTGCAGAAGGTCGCCATAGTACCGGTGGTATGGAT

GAACTGTATAAA
```

(LbCas12a (E795L)-APAPA-mCherry chimera DNA sequence)

SEQ ID NO: 417

```
ATGAGCAAACTGGAAAAGTTCACCAACTGTTATAGCCTGAGCAAAACCCTGCGTTTTAAAGCAATTCCGGTTGGTAA

AACCCAAGAGAACATTGATAATAAACGCCTGCTGGTCGAAGATGAAAAACGCGCTGAAGATTATAAAGGCGTGAAAA

AACTGCTGGATCGCTATTATCTGAGCTTCATTAACGATGTGCTGCACAGCATTAAACTGAAGAACCTGAACAACTAT

ATCAGCCTGTTTCGTAAAAAAACCCGCACCGAAAAGAAAACAAAGAGCTGGAAAACCTGGAAATCAATCTGCGTAA

AGAAATCGCCAAAGCGTTTAAAGGTAACGAGGGTTATAAAAGCCTGTTCAAGAAAGACATCATCGAAACCATTCTGC

CGGAATTTCTGGATGATAAAGATGAAATTGCCCTGGTGAATAGCTTTAATGGCTTTACCACCGCATTTACCGGCTTT

TTTGATAATCGCGAAAACATGTTCAGCGAAGAAGCAAAAAGCACCAGCATTGCATTTCGCTGCATTAATGAAAATCT
```

-continued

```
GACCCGCTACATTAGCAACATGGATATCTTTGAAAAAGTGGACGCGATCTTCGATAAACACGAAGTGCAAGAGATCA
AAGAGAAAATCCTGAACAGCGATTATGACGTCGAAGATTTTTTTGAAGGCGAGTTCTTTAACTTCGTTCTGACCCAA
GAAGGTATCGACGTTTATAACGCAATTATTGGTGGTTTTGTTACCGAAAGCGGTGAGAAAATCAAAGGCCTGAATGA
ATATATCAACCTGTATAACCAGAAAACCAAACAGAAACTGCCGAAATTCAAACCGCTGTATAAACAGGTTCTGAGCG
ATCGTGAAAGCCTGAGCTTTTATGGTGAAGGTTATACCAGTGATGAAGAGGTTCTGGAAGTTTTTCGTAACACCCTG
AATAAAAACAGCGAGATCTTTAGCAGCATCAAAAAGCTTGAGAAACTGTTCAAAAACTTTGATGAGTATAGCAGCGC
AGGCATCTTTGTTAAAAATGGTCCGGCAATTAGCACCATCAGCAAAGATATTTTTGGCGAATGGAATGTGATCCGCG
ATAAATGGAATGCCGAATATGATGATATCCACCTGAAAAAAAAGGCCGTGGTGACCGAGAAATATGAAGATGATCGT
CGTAAAAGCTTCAAGAAAATTGGTAGCTTTAGCCTGGAACAGCTGCAAGAATATGCAGATGCAGATCTGAGCGTTGT
GGAAAAACTGAAAGAAATCATCATTCAGAAGGTGGACGAGATCTATAAAGTTTATGGTAGCAGCGAAAAACTGTTCG
ATGCAGATTTTGTTCTGGAAAAAGCCTGAAAAAGAATGATGCCGTTGTGGCCATTATGAAAGATCTGCTGGATAGC
GTTAAGAGCTTCGAGAATTACATCAAAGCCTTTTTTGGTGAGGGCAAAGAAACCAATCGTGATGAAAGTTTCTATGG
CGATTTTGTGCTGGCCTATGATATTCTGCTGAAAGTGGACCATATTTATGATGCCATTCGCAATTATGTTACCCAGA
AACCGTATAGCAAAGACAAGTTCAAACTGTACTTTCAGAACCCGCAGTTTATGGGTGGTTGGGATAAAGATAAAGAA
ACCGATTATCGTGCCACCATCCTGCGTTATGGTAGTAAATACTATCTGGCCATCATGGACAAAAAATACGCAAAATG
CCTGCAGAAAATCGACAAAGATGATGTGAATGGCAACTATGAAAAAATCAACTACAAACTGCTGCCTGGTCCGAATA
AAAATGCTGCCGAAAGTGTTCTTTAGCAAGAAATGGATGGCCTATTATAACCCGAGCGAGGATATTCAAAAGATCTAC
AAAAATGGCACCTTTAAAAAGGGCGACATGTTCAATCTGAACGATTGCCACAAACTGATCGATTTCTTCAAAGATTC
AATTTCGCGTTATCCGAAATGGTCCAATGCCTATGATTTTAACTTTAGCGAAACCGAAAAATACAAAGACATTGCCG
GTTTTTATCGCGAAGTGGAAGAACAGGGCTATAAAGTGAGCTTTGAAAGCGCAAGCAAAAAAGAGGTTGATAAGCTG
GTTGAAGAGGGCAAACTGTATATGTTCCAGATTTACAACAAAGATTTTAGCGACAAAAGCCATGGCACCCCGAATCT
GCATACCATGTACTTTAAACTGCTGTTCGACGAAAATAACCATGGTCAGATTCGTCTGAGCGGTGGTGCCGAACTGT
TTATGCGTCGTGCAAGTCTGAAAAAAGAAGAACTGGTTGTTCATCCGGCAAATAGCCCGATTGCAAACAAAAATCCG
GACAATCCGAAAAAAACCACGACACTGAGCTATGATGTGTATAAAGACAAACGTTTTAGCGAGGATCAGTATCTGCT
GCATATCCCGATTGCCATCAATAAATGCCCGAAAAACATCTTTAAGATCAACACCGAAGTTCGCGTGCTGCTGAAAC
ATGATGATAATCCGTATGTGATTGGCATTGATCGTGGTGAACGTAACCTGCTGTATATTGTTGTTGTTGATGGTAAA
GGCAACATCGTGGAACAGTATAGTCTGAACGAAATTATCAACAACTTTAACGGCATCCGCATCAAAACCGACTATCA
TAGCCTGCTGGACAAGAAGAAAAAGAACGTTTTGAAGCACGTCAGAACTGGACCAGTATTGAAAACATCAAAGAAC
TGAAAGCCGGTTATATTAGCCAGGTGGTTCATAAAATCTGTGAGCTGGTAGAAAAATACGATGCAGTTATTGCACTG
GAAGATCTGAATAGCGGTTTCAAAAATAGCCGTGTGAAAGTCGAAAAACAGGTGTATCAGAAATTCGAGAAAATGCT
GATCGACAAACTGAACTACATGGTCGACAAAAAAAGCAATCCGTGTGCAACCGGTGGTGCACTGAAAGGTTATCAGA
TTACCAACAAATTTGAAAGCTTTAAAAGCATGAGCACCCAGAACGGCTTTATCTTCTATATTCCGGCATGGCTGACC
AGCAAAATTGATCCGAGCACCGGTTTTGTGAACCTGCTGAAAACAAAATATACCTCCATTGCCGACAGCAAGAAGTT
TATTAGCAGCTTTGATCGCATTATGTATGTTCCGGAAGAGGACCTGTTTGAATTCGCACTGGATTACAAAAATTTCA
GCCGTACCGATGCCGACTACATCAAAAAATGGAAACTGTACAGCTATGGTAACCGCATTCGCATTTTTCGCAACCCG
AAGAAAAACAATGTGTTCGATTGGGAAGAAGTTTGTCTGACCAGCGCATATAAAGAACTTTTCAACAAATACGGCAT
CAACTATCAGCAGGGTGATATTCGTGCACTGCTGTGTGAACAGAGCGATAAAGCGTTTTATAGCAGTTTTATGGCAC
TGATGAGCCTGATGCTGCAGATGCGTAATAGCATTACCGGTCGCACCGATGTGGATTTTCTGATTAGTCCGGTGAAA
AATTCCGATGGCATCTTTTATGATAGCCGCAATTACGAAGCACAAGAAAATGCAATTCTGCCGAAAAACGCAGATGC
AAATGGTGCATATAACATTGCACGTAAAGTTCTGTGGGCAATTGGCCAGTTTAAGAAAGCAGAAGATGAGAAGCTGG
ACAAAGTGAAAATTGCGATCAGCAATAAAGAGTGGCTGGAATACGCACAGACCAGCGTTAAACATGCTCCTGCACCT
```

-continued

```
GCGATGGTGAGCAAAGGTGAAGAGGATAATATGGCCATCATCAAAGAATTCATGCGCTTCAAAGTTCATATGGAAGG

TAGCGTTAATGGCCACGAATTTGAAATTGAAGGTGAAGGCGAAGGTCGTCCGTATGAAGGCACCCAGACCGCAAAC

TGAAAGTTACCAAAGGTGGTCCGCTGCCGTTTGCATGGGATATTCTGAGTCCGCAGTTTATGTATGGTAGCAAAGCC

TATGTTAAACATCCGGCAGATATCCCGGATTATCTGAAACTGAGCTTTCCGGAAGGTTTTAAATGGGAACGTGTGAT

GAATTTTGAAGATGGTGGTGTTGTTACCGTTACACAGGATAGCAGCCTGCAGGATGGTGAATTTATCTATAAAGTTA

AACTGCGTGGCACGAATTTTCCGAGTGATGGTCCGGTTATGCAGAAAAAAACCATGGGTTGGGAAGCAAGCAGCGAA

CGTATGTATCCGGAAGATGGCGCACTGAAAGGTGAAATTAAACAGCGTCTGAAGCTGAAAGATGGCGGTCATTATGA

TGCAGAAGTTAAAACCACCTACAAAGCCAAAAAACCGGTTCAGCTGCCTGGTGCATATAACGTTAACATTAAACTGG

ATATCACCAGCCACAACGAGGATTATACCATTGTTGAACAGTATGAACGTGCAGAAGGTCGCCATAGTACCGGTGGT

ATGGATGAACTGTATAAA
```

(LbCas12a (E795L)-APAPAPA-mCherry chimera DNA sequence)

SEQ ID NO: 418

```
ATGAGCAAACTGGAAAAGTTCACCAACTGTTATAGCCTGAGCAAAACCCTGCGTTTTAAAGCAATTCCGGTTGGTAA

AACCCAAGAGAACATTGATAATAAACGCCTGCTGGTCGAAGATGAAAAACGCGCTGAAGATTATAAAGGCGTGAAAA

AACTGCTGGATCGCTATTATCTGAGCTTCATTAACGATGTGCTGCACAGCATTAAACTGAAGAACCTGAACAACTAT

ATCAGCCTGTTTCGTAAAAAAACCCGCACCGAAAAAGAAAACAAAGAGCTGGAAAACCTGGAAATCAATCTGCGTAA

AGAAATCGCCAAAGCGTTTAAAGGTAACGAGGGTTATAAAAGCCTGTTCAAGAAAGACATCATCGAAACCATTCTGC

CGGAATTTCTGGATGATAAAGATGAAATTGCCCTGGTGAATAGCTTTAATGGCTTTACCACCGCATTTACCGGCTTT

TTTGATAATCGCGAAAACATGTTCAGCGAAGAAGCAAAAAGCACCAGCATTGCATTTCGCTGCATTAATGAAAATCT

GACCCGCTACATTAGCAACATGGATATCTTTGAAAAAGTGGACGCGATCTTCGATAAACACGAAGTGCAAGAGATCA

AAGAGAAAATCCTGAACAGCGATTATGACGTCGAAGATTTTTTTGAAGGCGAGTTCTTTAACTTCGTTCTGACCCAA

GAAGGTATCGACGTTTATAACGCAATTATTGGTGGTTTTGTTACCGAAAGCGGTGAGAAAATCAAAGGCCTGAATGA

ATATATCAACCTGTATAACCAGAAAACCAAACAGAAACTGCCGAAATTCAAACCGCTGTATAAACAGGTTCTGAGCG

ATCGTGAAAGCCTGAGCTTTTATGGTGAAGGTTATACCAGTGATGAAGAGGTTCTGGAAGTTTTTCGTAACACCCTG

AATAAAAACAGCGAGATCTTTAGCAGCATCAAAAAGCTTGAGAAACTGTTCAAAAACTTTGATGAGTATAGCAGCGC

AGGCATCTTTGTTAAAAATGGTCCGGCAATTAGCACCATCAGCAAAGATATTTTTGGCGAATGGAATGTGATCCGCG

ATAAATGGAATGCCGAATATGATGATATCCACCTGAAAAAAAAGGCCGTGGTGACCGAGAAATATGAAGATGATCGT

CGTAAAAGCTTCAAGAAAATTGGTAGCTTTAGCCTGGAACAGCTGCAAGAATATGCAGATGCAGATCTGAGCGTTGT

GGAAAAAACTGAAAGAAATCATCATTCAGAAGGTGGACGAGATCTATAAAGTTTATGGTAGCAGCGAAAAACTGTTCG

ATGCAGATTTTGTTCTGGAAAAAAGCCTGAAAAAGAATGATGCCGTTGTGGCCATTATGAAAGATCTGCTGGATAGC

GTTAAGAGCTTCGAGAATTACATCAAAGCCTTTTTTGGTGAGGGCAAAGAAACCAATCGTGATGAAAGTTTCTATGG

CGATTTTGTGCTGGCCTATGATATTCTGCTGAAAGTGGACCATATTTATGATGCCATTCGCAATTATGTTACCCAGA

AACCGTATAGCAAAGACAAGTTCAAACTGTACTTTCAGAACCCGCAGTTTATGGGTGGTTGGGATAAAGATAAGAA

ACCGATTATCGTGCCACCATCCTGCGTTATGGTAGTAAATACTATCTGGCCATCATGGACAAAAAATACGCAAAATG

CCTGCAGAAAATCGACAAAGATGATGTGAATGGCAACTATGAAAAAATCAACTACAAACTGCTGCCTGGTCCGAATA

AAATGCTGCCGAAAGTGTTCTTTAGCAAGAAATGGATGGCCTATTATAACCCGAGCGAGGATATTCAAAAGATCTAC

AAAAATGGCACCTTTAAAAAGGGCGACATGTTCAATCTGAACGATTGCCACAAACTGATCGATTTCTTCAAAGATTC

AATTTCGCGTTATCCGAAATGGTCCAATGCCTATGATTTTAACTTTAGCGAAACCGAAAAATACAAAGACATTGCCG

GTTTTTATCGCGAAGTGGAAGAACAGGGCTATAAAGTGAGCTTTGAAAGCGCAAGCAAAAAAGAGGTTGATAAGCTG

GTTGAAGAGGGCAAACTGTATATGTTCCAGATTTACAACAAAGATTTTAGCGACAAAAGCCATGGCACCCCCGAATCT

GCATACCATGTACTTTAAACTGCTGTTCGACGAAAATAACCATGGTCAGATTCGTCTGAGCGGTGGTGCCGAACTGT
```

-continued

```
TTATGCGTCGTGCAAGTCTGAAAAAAGAAGAACTGGTTGTTCATCCGGCAAATAGCCCGATTGCAAACAAAAATCCG

GACAATCCGAAAAAAACCACGACACTGAGCTATGATGTGTATAAAGACAAACGTTTTAGCGAGGATCAGTATCTGCT

GCATATCCCGATTGCCATCAATAAATGCCCGAAAAACATCTTTAAGATCAACACCGAAGTTCGCGTGCTGCTGAAAC

ATGATGATAATCCGTATGTGATTGGCATTGATCGTGGTAACGTAACCTGCTGTATATTGTTGTTGTTGATGGTAAA

GGCAACATCGTGGAACAGTATAGTCTGAACGAAATTATCAACAACTTTAACGGCATCCGCATCAAAACCGACTATCA

TAGCCTGCTGGACAAGAAAGAAAAAGAACGTTTTGAAGCACGTCAGAACTGGACCAGTATTGAAAACATCAAAGAAC

TGAAAGCCGGTTATATTAGCCAGGTGGTTCATAAAATCTGTGAGCTGGTAGAAAAATACGATGCAGTTATTGCACTG

GAAGATCTGAATAGCGGTTTCAAAAATAGCCGTGTGAAAGTCGAAAAACAGGTGTATCAGAAATTCGAGAAAATGCT

GATCGACAAACTGAACTACATGGTCGACAAAAAAAGCAATCCGTGTGCAACCGGTGGTGCACTGAAAGGTTATCAGA

TTACCAACAAATTTGAAAGCTTTAAAAGCATGAGCACCCAGAACGGCTTTATCTTCTATATTCCGGCATGGCTGACC

AGCAAAATTGATCCGAGCACCGGTTTTGTGAACCTGCTGAAAACAAAATATACCTCCATTGCCGACAGCAAGAAGTT

TATTAGCAGCTTTGATCGCATTATGTATGTTCCGGAAGAGGACCTGTTTGAATTCGCACTGGATTACAAAAATTTCA

GCCGTACCGATGCCGACTACATCAAAAAATGGAAACTGTACAGCTATGGTAACCGCATTCGCATTTTTCGCAACCCG

AAGAAAAACAATGTGTTCGATTGGGAAGAAGTTTGTCTGACCAGCGCATATAAAGAACTTTTCAACAAATACGGCAT

CAACTATCAGCAGGGTGATATTCGTGCACTGCTGTGTGAACAGAGCGATAAAGCGTTTTATAGCAGTTTTATGGCAC

TGATGAGCCTGATGCTGCAGATGCGTAATAGCATTACCGGTCGCACCGATGTGGATTTTCTGATTAGTCCGGTGAAA

AATTCCGATGGCATCTTTTATGATAGCCGCAATTACGAAGCACAAGAAAATGCAATTCTGCCGAAAAACGCAGATGC

AAATGGTGCATATAACATTGCACGTAAAGTTCTGTGGGCAATTGGCCAGTTTAAGAAAGCAGAAGATGAGAAGCTGG

ACAAAGTGAAAATTGCGATCAGCAATAAAGAGTGGCTGGAATACGCACAGACCAGCGTTAAACATGCGCCAGCTCCT

GCACCTGCGATGGTGAGCAAAGGTGAAGAGGATAATATGGCCATCATCAAAGAATTCATGCGCTTCAAAGTTCATAT

GGAAGGTAGCGTTAATGGCCACGAATTTGAAATTGAAGGTGAAGGCGAAGGTCGTCCGTATGAAGGCACCCAGACCG

CAAAACTGAAAGTTACCAAAGGTGGTCCGCTGCCGTTTGCATGGGATATTCTGAGTCCGCAGTTTATGTATGGTAGC

AAAGCCTATGTTAAACATCCGGCAGATATCCCGGATTATCTGAAACTGAGCTTTCCGGAAGGTTTTAAATGGGAACG

TGTGATGAATTTTGAAGATGGTGGTGTTGTTACCGTTACACAGGATAGCAGCCTGCAGGATGGTGAATTTATCTATA

AAGTTAAACTGCGTGGCACGAATTTTCCGAGTGATGGTCCGGTTATGCAGAAAAAAACCATGGGTTGGGAAGCAAGC

AGCGAACGTATGTATCCGGAAGATGGCGCACTGAAAGGTGAAATTAAACAGCGTCTGAAGCTGAAAGATGGCGGTCA

TTATGATGCAGAAGTTAAAACCACCTACAAAGCCAAAAAACCGGTTCAGCTGCCTGGTGCATATAACGTTAACATTA

AACTGGATATCACCAGCCACAACGAGGATTATACCATTGTTGAACAGTATGAACGTGCAGAAGGTCGCCATAGTACC

GGTGGTATGGATGAACTGTATAAA
```

(LbCas12a (E795L)-APAPAPAPA-mCherry chimera DNA sequence)

SEQ ID NO: 419

```
ATGAGCAAACTGGAAAAGTTCACCAACTGTTATAGCCTGAGCAAAACCCTGCGTTTTAAAGCAATTCCGGTTGGTAA

AACCCAAGAGAACATTGATAATAAACGCCTGCTGGTCGAAGATGAAAAACGCGCTGAAGATTATAAAGGCGTGAAAA

AACTGCTGGATCGCTATTATCTGAGCTTCATTAACGATGTGCTGCACAGCATTAAACTGAAGAACCTGAACAACTAT

ATCAGCCTGTTTCGTAAAAAAACCCGCACCGAAAAGAAAACAAAGAGCTGGAAAACCTGGAAATCAATCTGCGTAA

AGAAATCGCCAAAGCGTTTAAAGGTAACGAGGGTTATAAAAGCCTGTTCAAGAAAGACATCATCGAAACCATTCTGC

CGGAATTTCTGGATGATAAAGATGAAATTGCCCTGGTGAATAGCTTTAATGGCTTTACCACCGCATTTACCGGCTTT

TTTGATAATCGCGAAAACATGTTCAGCGAAGAAGCAAAAAGCACCAGCATTGCATTTCGCTGCATTAATGAAAATCT

GACCCGCTACATTAGCAACATGGATATCTTTGAAAAAGTGGACGCGATCTTCGATAAACACGAAGTGCAAGAGATCA

AAGAGAAAATCCTGAACAGCGATTATGACGTCGAAGATTTTTTTGAAGGCGAGTTCTTTAACTTCGTTCTGACCCAA

GAAGGTATCGACGTTTATAACGCAATTATTGGTGGTTTTGTTACCGAAAGCGGTGAGAAAATCAAAGGCCTGAATGA

ATATATCAACCTGTATAACCAGAAAACCAAACAGAAACTGCCGAAATTCAAACCGCTGTATAAACAGGTTCTGAGCG
```

-continued

```
ATCGTGAAAGCCTGAGCTTTTATGGTGAAGGTTATACCAGTGATGAAGAGGTTCTGGAAGTTTTTCGTAACACCCTG

AATAAAAACAGCGAGATCTTTAGCAGCATCAAAAAGCTTGAGAAACTGTTCAAAAACTTTGATGAGTATAGCAGCGC

AGGCATCTTTGTTAAAAATGGTCCGGCAATTAGCACCATCAGCAAAGATATTTTTGGCGAATGGAATGTGATCCGCG

ATAAATGGAATGCCGAATATGATGATATCCACCTGAAAAAAAAGGCCGTGGTGACCGAGAAATATGAAGATGATCGT

CGTAAAAGCTTCAAGAAAATTGGTAGCTTTAGCCTGGAACAGCTGCAAGAATATGCAGATGCAGATCTGAGCGTTGT

GGAAAAACTGAAAGAAATCATCATTCAGAAGGTGGACGAGATCTATAAAGTTTATGGTAGCAGCGAAAAACTGTTCG

ATGCAGATTTTGTTCTGGAAAAAAGCCTGAAAAAGAATGATGCCGTTGTGGCCATTATGAAAGATCTGCTGGATAGC

GTTAAGAGCTTCGAGAATTACATCAAAGCCTTTTTTGGTGAGGGCAAAGAAACCAATCGTGATGAAAGTTTCTATGG

CGATTTTGTGCTGGCCTATGATATTCTGCTGAAAGTGGACCATATTTATGATGCCATTCGCAATTATGTTACCCAGA

AACCGTATAGCAAAGACAAGTTCAAACTGTACTTTCAGAACCCGCAGTTTATGGGTGGTTGGGATAAAGATAAAGAA

ACCGATTATCGTGCCACCATCCTGCGTTATGGTAGTAAATACTATCTGGCCATCATGGACAAAAAATACGCAAAATG

CCTGCAGAAAATCGACAAAGATGATGTGAATGGCAACTATGAAAAAATCAACTACAAACTGCTGCCTGGTCCGAATA

AAATGCTGCCGAAAGTGTTCTTTAGCAAGAAATGGATGGCCTATTATAACCCGAGCGAGGATATTCAAAGATCTAC

AAAAATGGCACCTTTAAAAAGGGCGACATGTTCAATCTGAACGATTGCCACAAACTGATCGATTTCTTCAAAGATTC

AATTTCGCGTTATCCGAAATGGTCCAATGCCTATGATTTTAACTTTAGCGAAACCGAAAAATACAAAGACATTGCCG

GTTTTTATCGCGAAGTGGAAGAACAGGGCTATAAAGTGAGCTTTGAAAGCGCAAGCAAAAAGAGGTTGATAAGCTG

GTTGAAGAGGGCAAACTGTATATGTTCCAGATTTACAACAAAGATTTTAGCGACAAAAGCCATGGCACCCCGAATCT

GCATACCATGTACTTTAAACTGCTGTTCGACGAAAATAACCATGGTCAGATTCGTCTGAGCGGTGGTGCCGAACTGT

TTATGCGTCGTGCAAGTCTGAAAAAAGAAGAACTGGTTGTTCATCCGGCAAATAGCCCGATTGCAAACAAAAATCCG

GACAATCCGAAAAAACCACGACACTGAGCTATGATGTGTATAAAGACAAACGTTTTAGCGAGGATCAGTATCTGCT

GCATATCCCGATTGCCATCAATAAATGCCCGAAAAACATCTTTAAGATCAACACCGAAGTTCGCGTGCTGCTGAAAC

ATGATGATAATCCGTATGTGATTGGCATTGATCGTGGTGAACGTAACCTGCTGTATATTGTTGTTGTTGATGGTAAA

GGCAACATCGTGGAACAGTATAGTCTGAACGAAATTATCAACAACTTTAACGGCATCCGCATCAAAACCGACTATCA

TAGCCTGCTGGACAAGAAAGAAAAAGAACGTTTTGAAGCACGTCAGAACTGGACCAGTATTGAAAACATCAAAGAAC

TGAAAGCCGGTTATATTAGCCAGGTGGTTCATAAAATCTGTGAGCTGGTAGAAAAATACGATGCAGTTATTGCACTG

GAAGATCTGAATAGCGGTTTCAAAAATAGCCGTGTGAAAGTCGAAAAACAGGTGTATCAGAAATTCGAGAAAATGCT

GATCGACAAACTGAACTACATGGTCGACAAAAAAAGCAATCCGTGTGCAACCGGTGGTGCACTGAAAGGTTATCAGA

TTACCAACAAATTTGAAAGCTTTAAAAGCATGAGCACCCAGAACGGCTTTATCTTCTATATTCCGGCATGGCTGACC

AGCAAAATTGATCCGAGCACCGGTTTTGTGAACCTGCTGAAAACAAAATATACCTCCATTGCCGACAGCAAGAAGTT

TATTAGCAGCTTTGATCGCATTATGTATGTTCCGGAAGAGGACCTGTTTGAATTCGCACTGGATTACAAAAATTTCA

GCCGTACCGATGCCGACTACATCAAAAAATGGAAACTGTACAGCTATGGTAACCGCATTCGCATTTTTCGCAACCCG

AAGAAAAACAATGTGTTCGATTGGGAAGAAGTTTGTCTGACCAGCGCATATAAAGAACTTTTCAACAAATACGGCAT

CAACTATCAGCAGGGTGATATTCGTGCACTGCTGTGTGAACAGAGCGATAAAGCGTTTTATAGCAGTTTTATGGCAC

TGATGAGCCTGATGCTGCAGATGCGTAATAGCATTACCGGTCGCACCGATGTGGATTTTCTGATTAGTCCGGTGAAA

AATTCCGATGGCATCTTTTATGATAGCCGCAATTACGAAGCACAAGAAATGCAATTCTGCCGAAAAACGCAGATGC

AAATGGTGCATATAACATTGCACGTAAAGTTCTGTGGGCAATTGGCCAGTTTAAGAAAGCAGAAGATGAGAAGCTGG

ACAAAGTGAAAATTGCGATCAGCAATAAAGAGTGGCTGGAATACGCACAGACCAGCGTTAAACATGCTCCTGCGCCA

GCTCCTGCACCTGCGATGGTGAGCAAAGGTGAAGAGGATAATATGGCCATCATCAAAGAATTCATGCGCTTCAAAGT

TCATATGGAAGGTAGCGTTAATGGCCACGAATTTGAAATTGAAGGTGAAGGCGAAGGTCGTCCGTATGAAGGCACCC

AGACCGCAAAACTGAAAGTTACCAAAGGTGGTCCGCTGCCGTTTGCATGGGATATTCTGAGTCCGCAGTTTATGTAT
```

-continued

GGTAGCAAAGCCTATGTTAAACATCCGGCAGATATCCCGGATTATCTGAAACTGAGCTTTCCGGAAGGTTTTAAATG

GGAACGTGTGATGAATTTTGAAGATGGTGGTGTTGTTACCGTTACACAGGATAGCAGCCTGCAGGATGGTGAATTTA

TCTATAAAGTTAAACTGCGTGGCACGAATTTTCCGAGTGATGGTCCGGTTATGCAGAAAAAAACCATGGGTTGGGAA

GCAAGCAGCGAACGTATGTATCCGGAAGATGGCGCACTGAAAGGTGAAATTAAACAGCGTCTGAAGCTGAAAGATGG

CGGTCATTATGATGCAGAAGTTAAAACCACCTACAAAGCCAAAAAACCGGTTCAGCTGCCTGGTGCATATAACGTTA

ACATTAAACTGGATATCACCAGCCACAACGAGGATTATACCATTGTTAACAGTATGAACGTGCAGAAGGTCGCCAT

AGTACCGGTGGTATGGATGAACTGTATAAA (LbCas12a (E795L)-APAPAPAPAPA-mCherry chimera DNA sequence)

SEQ ID NO: 420

ATGAGCAAACTGGAAAAGTTCACCAACTGTTATAGCCTGAGCAAAACCCTGCGTTTTAAAGCAATTCCGGTTGGTAA

AACCCAAGAGAACATTGATAATAAACGCCTGCTGGTCGAAGATGAAAAACGCGCTGAAGATTATAAAGGCGTGAAAA

AACTGCTGGATCGCTATTATCTGAGCTTCATTAACGATGTGCTGCACAGCATTAAACTGAAGAACCTGAACAACTAT

ATCAGCCTGTTTCGTAAAAAAACCCGCACCGAAAAGAAAACAAAGAGCTGGAAAACCTGGAAATCAATCTGCGTAA

AGAAATCGCCAAAGCGTTTAAAGGTAACGAGGGTTATAAAAGCCTGTTCAAGAAAGACATCATCGAAACCATTCTGC

CGGAATTTCTGGATGATAAAGATGAAATTGCCCTGGTGAATAGCTTTAATGGCTTTACCACCGCATTTACCGGCTTT

TTTGATAATCGCGAAACATGTTCAGCGAAGAAGCAAAAAGCACCAGCATTGCATTTCGCTGCATTAATGAAAATCT

GACCCGCTACATTAGCAACATGGATATCTTTGAAAAAGTGGACGCGATCTTCGATAAACACGAAGTGCAAGAGATCA

AAGAGAAAATCCTGAACAGCGATTATGACGTCGAAGATTTTTTTGAAGGCGAGTTCTTTAACTTCGTTCTGACCCAA

GAAGGTATCGACGTTTATAACGCAATTATTGGTGGTTTTGTTACCGAAAGCGGTGAGAAAATCAAAGGCCTGAATGA

ATATATCAACCTGTATAACCAGAAAACCAAACAGAAACTGCCGAAATTCAAACCGCTGTATAAACAGGTTCTGAGCG

ATCGTGAAAGCCTGAGCTTTTATGGTGAAGGTTATACCAGTGATGAAGAGGTTCTGGAAGTTTTTCGTAACACCCTG

AATAAAAACAGCGAGATCTTTAGCAGCATCAAAAAGCTTGAGAAACTGTTCAAAAACTTTGATGAGTATAGCAGCGC

AGGCATCTTTGTTAAAAATGGTCCGGCAATTAGCACCATCAGCAAAGATATTTTTGGCGAATGGAATGTGATCCGCG

ATAAATGGAATGCCGAATATGATGATATCCACCTGAAAAAAAAGGCCGTGGTGACCGAGAAATATGAAGATGATCGT

CGTAAAAGCTTCAAGAAAATTGGTAGCTTTAGCCTGGAACAGCTGCAAGAATATGCAGATGCAGATCTGAGCGTTGT

GGAAAAAACTGAAAGAAATCATCATTCAGAAGGTGGACGAGATCTATAAAGTTTATGGTAGCAGCGAAAAACTGTTCG

ATGCAGATTTTGTTCTGGAAAAAAGCCTGAAAAAGAATGATGCCGTTGTGGCCATTATGAAAGATCTGCTGGATAGC

GTTAAGAGCTTCGAGAATTACATCAAAGCCTTTTTTGGTGAGGGCAAAGAAACCAATCGTGATGAAAGTTTCTATGG

CGATTTTGTGCTGGCCTATGATATTCTGCTGAAAGTGGACCATATTTATGATGCCATTCGCAATTATGTTACCCAGA

AACCGTATAGCAAAGACAAGTTCAAACTGTACTTTCAGAACCCGCAGTTTATGGGTGGTTGGGATAAAGATAAAGAA

ACCGATTATCGTGCCACCATCCTGCGTTATGGTAGTAAATACTATCTGGCCATCATGGACAAAAAATACGCAAAATG

CCTGCAGAAAATCGACAAAGATGATGTGAATGGCAACTATGAAAAAATCAACTACAAACTGCTGCCTGGTCCGAATA

AAATGCTGCCGAAAGTGTTCTTTAGCAAGAAATGGATGGCCTATTATAACCCGAGCGAGGATATTCAAAAGATCTAC

AAAAATGGCACCTTTAAAAAGGGCGACATGTTCAATCTGAACGATTGCCACAAACTGATCGATTTCTTCAAAGATTC

AATTTCGCGTTATCCGAAATGGTCCAATGCCTATGATTTTAACTTTAGCGAAACCGAAAAATACAAAGACATTGCCG

GTTTTTATCGCGAAGTGGAAGAACAGGGCTATAAAGTGAGCTTTGAAAGCGCAAGCAAAAAGGAGGTTGATAAGCTG

GTTGAAGAGGGCAAACTGTATATGTTCCAGATTTACAACAAAGATTTTAGCGACAAAAGCCATGGCACCCCCGAATCT

GCATACCATGTACTTTAAACTGCTGTTCGACGAAAATAACCATGGTCAGATTCGTCTGAGCGGTGGTGCCGAACTGT

TTATGCGTCGTGCAAGTCTGAAAAAAGAAGAACTGGTTGTTCATCCGGCAAATAGCCCGATTGCAAACAAAAATCCG

GACAATCCGAAAAAAACCACGACACTGAGCTATGATGTGTATAAAGACAAACGTTTTAGCGAGGATCAGTATCTGCT

GCATATCCCGATTGCCATCAATAAATGCCCGAAAAACATCTTTAAGATCAACACCGAAGTTCGCGTGCTGCTGAAAC

ATGATGATAATCCGTATGTGATTGGCATTGATCGTGGTGAACGTAACCTGCTGTATATTGTTGTTGTTGATGGTAAA

```
GGCAACATCGTGGAACAGTATAGTCTGAACGAAATTATCAACAACTTTAACGGCATCCGCATCAAAACCGACTATCA
TAGCCTGCTGGACAAGAAAGAAAAAGAACGTTTTGAAGCACGTCAGAACTGGACCAGTATTGAAAACATCAAAGAAC
TGAAAGCCGGTTATATTAGCCAGGTGGTTCATAAAATCTGTGAGCTGGTAGAAAAATACGATGCAGTTATTGCACTG
GAAGATCTGAATAGCGGTTTCAAAAATAGCCGTGTGAAAGTCGAAAAACAGGTGTATCAGAATTCGAGAAAATGCT
GATCGACAAACTGAACTACATGGTCGACAAAAAAAGCAATCCGTGTGCAACCGGTGGTGCACTGAAAGGTTATCAGA
TTACCAACAAATTTGAAAGCTTTAAAGCATGAGCACCCAGAACGGCTTTATCTTCTATATTCCGGCATGGCTGACC
AGCAAAATTGATCCGAGCACCGGTTTTGTGAACCTGCTGAAAACAAAATATACCTCCATTGCCGACAGCAAGAAGTT
TATTAGCAGCTTTGATCGCATTATGTATGTTCCGGAAGAGGACCTGTTTGAATTCGCACTGGATTACAAAAATTTCA
GCCGTACCGATGCCGACTACATCAAAAAATGGAAACTGTACAGCTATGGTAACCGCATTCGCATTTTTCGCAACCCG
AAGAAAAACAATGTGTTCGATTGGGAAGAAGTTTGTCTGACCAGCGCATATAAAGAACTTTTCAACAAATACGGCAT
CAACTATCAGCAGGGTGATATTCGTGCACTGCTGTGTGAACAGAGCGATAAAGCGTTTTATAGCAGTTTTATGGCAC
TGATGAGCCTGATGCTGCAGATGCGTAATAGCATTACCGGTCGCACCGATGTGGATTTTCTGATTAGTCCGGTGAAA
AATTCCGATGGCATCTTTTATGATAGCCGCAATTACGAAGCACAAGAAATGCAATTCTGCCGAAAAACGCAGATGC
AAATGGTGCATATAACATTGCACGTAAAGTTCTGTGGGCAATTGGCCAGTTTAAGAAAGCAGAAGATGAGAAGCTGG
ACAAAGTGAAAATTGCGATCAGCAATAAAGAGTGGCTGGAATACGCACAGACCAGCGTTAAACATGCGCCCGCTCCT
GCGCCAGCTCCTGCACCTGCGATGGTGAGCAAAGGTGAAGAGGATAATATGGCCATCATCAAAGAATTCATGCGCTT
CAAAGTTCATATGGAAGGTAGCGTTAATGGCCACGAATTTGAAATTGAAGGTGAAGGCGAAGGTCGTCCGTATGAAG
GCACCCAGACCGCAAAACTGAAAGTTACCAAAGGTGGTCCGCTGCCGTTTGCATGGGATATTCTGAGTCCGCAGTTT
ATGTATGGTAGCAAAGCCTATGTTAAACATCCGGCAGATATCCCGGATTATCTGAAACTGAGCTTTCCGGAAGGTTT
TAAATGGGAACGTGTGATGAATTTTGAAGATGGTGGTGTTGTTACCGTTACACAGGATAGCAGCCTGCAGGATGGTG
AATTTATCTATAAAGTTAAACTGCGTGGCACGAATTTTCCGAGTGATGGTCCGGTTATGCAGAAAAAAACCATGGGT
TGGGAAGCAAGCAGCGAACGTATGTATCCGGAAGATGGCGCACTGAAAGGTGAAATTAAACAGCGTCTGAAGCTGAA
AGATGGCGGTCATTATGATGCAGAAGTTAAAACCACCTACAAAGCCAAAAAACCGGTTCAGCTGCCTGGTGCATATA
ACGTTAACATTAAACTGGATATCACCAGCCACAACGAGGATTATACCATTGTTGAACAGTATGAACGTGCAGAAGGT
CGCCATAGTACCGGTGGTATGGATGAACTGTATAAA
```
(LbCas12a (E795L)-APAPAPAPAPAPAPA-mCherry chimera DNA sequence)

SEQ ID NO: 421
```
ATGAGCAAACTGGAAAAGTTCACCAACTGTTATAGCCTGAGCAAAACCCTGCGTTTTAAAGCAATTCCGGTTGGTAA
AACCCAAGAGAACATTGATAATAAACGCCTGCTGGTCGAAGATGAAAAACGCGCTGAAGATTATAAAGGCGTGAAAA
AACTGCTGGATCGCTATTATCTGAGCTTCATTAACGATGTGCTGCACAGCATTAAACTGAAGAACCTGAACAACTAT
ATCAGCCTGTTTCGTAAAAAAACCCGCACCGAAAAGAAAACAAAGAGCTGGAAAACCTGGAAATCAATCTGCGTAA
AGAAATCGCCAAAGCGTTTAAAGGTAACGAGGGTTATAAAAGCCTGTTCAAGAAAGACATCATCGAAACCATTCTGC
CGGAATTTCTGGATGATAAAGATGAAATTGCCCTGGTGAATAGCTTTAATGGCTTTACCACCGCATTTACCGGCTTT
TTTGATAATCGCGAAAACATGTTCAGCGAAGAAGCAAAAAGCACCAGCATTGCATTTCGCTGCATTAATGAAAATCT
GACCCGCTACATTAGCAACATGGATATCTTTGAAAAAGTGGACGCGATCTTCGATAAACACGAAGTGCAAGAGATCA
AAGAGAAAATCCTGAACAGCGATTATGACGTCGAAGATTTTTTTGAAGGCGAGTTCTTTAACTTCGTTCTGACCCAA
GAAGGTATCGACGTTTATAACGCAATTATTGGTGGTTTTGTTACCGAAAGCGGTGAGAAAATCAAAGGCCTGAATGA
ATATATCAACCTGTATAACCAGAAAACCAAACAGAAACTGCCGAAATTCAAACCGCTGTATAAACAGGTTCTGAGCG
ATCGTGAAAGCCTGAGCTTTTATGGTGAAGGTTATACCAGTGATGAAGAGGTTCTGGAAGTTTTTCGTAACACCCTG
AATAAAAACAGCGAGATCTTTAGCAGCATCAAAAAGCTTGAGAAACTGTTCAAAAACTTTGATGAGTATAGCAGCGC
AGGCATCTTTGTTAAAAATGGTCCGGCAATTAGCACCATCAGCAAAGATATTTTTGGCGAATGGAATGTGATCCGCG
```

-continued

```
ATAAATGGAATGCCGAATATGATGATATCCACCTGAAAAAAAGGCCGTGGTGACCGAGAAATATGAAGATGATCGT
CGTAAAAGCTTCAAGAAAATTGGTAGCTTTAGCCTGGAACAGCTGCAAGAATATGCAGATGCAGATCTGAGCGTTGT
GGAAAAACTGAAAGAAATCATCATTCAGAAGGTGGACGAGATCTATAAAGTTTATGGTAGCAGCGAAAAACTGTTCG
ATGCAGATTTTGTTCTGGAAAAAAGCCTGAAAAAGAATGATGCCGTTGTGGCCATTATGAAAGATCTGCTGGATAGC
GTTAAGAGCTTCGAGAATTACATCAAAGCCTTTTTTGGTGAGGGCAAAGAAACCAATCGTGATGAAAGTTTCTATGG
CGATTTTGTGCTGGCCTATGATATTCTGCTGAAAGTGGACCATATTTATGATGCCATTCGCAATTATGTTACCCAGA
AACCGTATAGCAAAGACAAGTTCAAACTGTACTTTCAGAACCCGCAGTTTATGGGTGGTTGGGATAAAGATAAAGAA
ACCGATTATCGTGCCACCATCCTGCGTTATGGTAGTAAATACTATCTGGCCATCATGGACAAAAAATACGCAAAATG
CCTGCAGAAAATCGACAAAGATGATGTGAATGGCAACTATGAAAAAATCAACTACAAACTGCTGCCTGGTCCGAATA
AAATGCTGCCGAAAGTGTTCTTTAGCAAGAAATGGATGGCCTATTATAACCCGAGCGAGGATATTCAAAAGATCTAC
AAAAATGGCACCTTTAAAAAGGGCGACATGTTCAATCTGAACGATTGCCACAAACTGATCGATTTCTTCAAAGATTC
AATTTCGCGTTATCCGAAATGGTCCAATGCCTATGATTTTAACTTTAGCGAAACCGAAAAATACAAAGACATTGCCG
GTTTTTATCGCGAAGTGGAAGAACAGGGCTATAAAGTGAGCTTTGAAAGCGCAAGCAAAAAAGAGGTTGATAAGCTG
GTTGAAGAGGGCAAACTGTATATGTTCCAGATTTACAACAAAGATTTTAGCGACAAAAGCCATGGCACCCCGAATCT
GCATACCATGTACTTTAAACTGCTGTTCGACGAAAATAACCATGGTCAGATTCGTCTGAGCGGTGGTGCCGAACTGT
TTATGCGTCGTGCAAGTCTGAAAAAAGAAGAACTGGTTGTTCATCCGGCAAATAGCCCGATTGCAAACAAAAATCCG
GACAATCCGAAAAAAACCACGACACTGAGCTATGATGTGTATAAAGACAAACGTTTTAGCGAGGATCAGTATCTGCT
GCATATCCCGATTGCCATCAATAAATGCCCGAAAAACATCTTTAAGATCAACACCGAAGTTCGCGTGCTGCTGAAAC
ATGATGATAATCCGTATGTGATTGGCATTGATCGTGGTGAACGTAACCTGCTGTATATTGTTGTTGTTGATGGTAAA
GGCAACATCGTGGAACAGTATAGTCTGAACGAAATTATCAACAACTTTAACGGCATCCGCATCAAAACCGACTATCA
TAGCCTGCTGGACAAGAAAGAAAAAGAACGTTTTGAAGCACGTCAGAACTGGACCAGTATTGAAAACATCAAAGAAC
TGAAAGCCGGTTATATTAGCCAGGTGGTTCATAAAATCTGTGAGCTGGTAGAAAAATACGATGCAGTTATTGCACTG
GAAGATCTGAATAGCGGTTTCAAAAATAGCCGTGTGAAAGTCGAAAAACAGGTGTATCAGAAATTCGAGAAAATGCT
GATCGACAAACTGAACTACATGGTCGACAAAAAAAGCAATCCGTGTGCAACCGGTGGTGCACTGAAAGGTTATCAGA
TTACCAACAAATTTGAAAGCTTTAAAAGCATGAGCACCCAGAACGGCTTTATCTTCTATATTCCGGCATGGCTGACC
AGCAAAATTGATCCGAGCACCGGTTTTGTGAACCTGCTGAAAACAAAATATACCTCCATTGCCGACAGCAAGAAGTT
TATTAGCAGCTTTGATCGCATTATGTATGTTCCGGAAGAGGACCTGTTTGAATTCGCACTGGATTACAAAAATTTCA
GCCGTACCGATGCCGACTACATCAAAAAATGGAAACTGTACAGCTATGGTAACCGCATTCGCATTTTTCGCAACCCG
AAGAAAAACAATGTGTTCGATTGGGAAGAAGTTTGTCTGACCAGCGCATATAAAGAACTTTTCAACAAATACGGCAT
CAACTATCAGCAGGGTGATATTCGTGCACTGCTGTGTGAACAGAGCGATAAAGCGTTTTATAGCAGTTTTATGGCAC
TGATGAGCCTGATGCTGCAGATGCGTAATAGCATTACCGGTCGCACCGATGTGGATTTTCTGATTAGTCCGGTGAAA
AATTCCGATGGCATCTTTTATGATAGCCGCAATTACGAAGCACAAGAAAATGCAATTCTGCCGAAAAACGCAGATGC
AAATGGTGCATATAACATTGCACGTAAAGTTCTGTGGGCAATTGGCCAGTTTAAGAAAGCAGAAGATGAGAAGCTGG
ACAAAGTGAAAATTGCGATCAGCAATAAAGAGTGGCTGGAATACGCACAGACCAGCGTTAAACATGCGCCAGCGCCT
GCTCCTGCACCCGCTCCAGCACCTGCGATGGTGAGCAAAGGTGAAGAGGATAATATGGCCATCATCAAAGAATTCAT
GCGCTTCAAAGTTCATATGGAAGGTAGCGTTAATGGCCACGAATTTGAAATTGAAGGTGAAGGCGAAGGTCGTCCGT
ATGAAGGCACCCAGACCGCAAAACTGAAAGTTACCAAAGGTGGTCCGCTGCCGTTTGCATGGGATATTCTGAGTCCG
CAGTTTATGTATGGTAGCAAAGCCTATGTTAAACATCCGGCAGATATCCCGGATTATCTGAAACTGAGCTTTCCGGA
AGGTTTTAAATGGGAACGTGTGATGAATTTTGAAGATGGTGGTGTTGTTACCGTTACACAGGATAGCAGCCTGCAGG
ATGGTGAATTTATCTATAAAGTTAAACTGCGTGGCACGAATTTTCCGAGTGATGGTCCGGTTATGCAGAAAAAAACC
ATGGGTTGGGAAGCAAGCAGCGAACGTATGTATCCGGAAGATGGCGCACTGAAAGGTGAAATTAAACAGCGTCTGAA
```

-continued

GCTGAAAGATGGCGGTCATTATGATGCAGAAGTTAAAACCACCTACAAAGCCAAAAAACCGGTTCAGCTGCCTGGTG

CATATAACGTTAACATTAAACTGGATATCACCAGCCACAACGAGGATTATACCATTGTTAACAGTATGAACGTGCA

GAAGGTCGCCATAGTACCGGTGGTATGGATGAACTGTATAAA (LbCas12a (E795L)-APAPAPAPAPAPAPAPA-mCherry chimera DNA sequence)

SEQ ID NO: 422

ATGAGCAAACTGGAAAAGTTCACCAACTGTTATAGCCTGAGCAAAACCCTGCGTTTTAAAGCAATTCCGGTTGGTAA

AACCCAAGAGAACATTGATAATAAACGCCTGCTGGTCGAAGATGAAAAACGCGCTGAAGATTATAAAGGCGTGAAAA

AACTGCTGGATCGCTATTATCTGAGCTTCATTAACGATGTGCTGCACAGCATTAAACTGAAGAACCTGAACAACTAT

ATCAGCCTGTTTCGTAAAAAAACCCGCACCGAAAAGAAAACAAAGAGCTGGAAAACCTGGAAATCAATCTGCGTAA

AGAAATCGCCAAAGCGTTTAAAGGTAACGAGGGTTATAAAAGCCTGTTCAAGAAAGACATCATCGAAACCATTCTGC

CGGAATTTCTGGATGATAAAGATGAAATTGCCCTGGTGAATAGCTTTAATGGCTTTACCACCGCATTTACCGGCTTT

TTTGATAATCGCGAAAACATGTTCAGCGAAGAAGCAAAAAGCACCAGCATTGCATTTCGCTGCATTAATGAAAATCT

GACCCGCTACATTAGCAACATGGATATCTTTGAAAAAGTGGACGCGATCTTCGATAAACACGAAGTGCAAGAGATCA

AAGAGAAAATCCTGAACAGCGATTATGACGTCGAAGATTTTTTTGAAGGCGAGTTCTTTAACTTCGTTCTGACCCAA

GAAGGTATCGACGTTTATAACGCAATTATTGGTGGTTTTGTTACCGAAAGCGGTGAGAAAATCAAAGGCCTGAATGA

ATATATCAACCTGTATAACCAGAAAACCAAACAGAAACTGCCGAAATTCAAACCGCTGTATAAACAGGTTCTGAGCG

ATCGTGAAAGCCTGAGCTTTTATGGTGAAGGTTATACCAGTGATGAAGAGGTTCTGGAAGTTTTTCGTAACACCCTG

AATAAAAACAGCGAGATCTTTAGCAGCATCAAAAAGCTTGAGAAACTGTTCAAAAACTTTGATGAGTATAGCAGCGC

AGGCATCTTTGTTAAAAATGGTCCGGCAATTAGCACCATCAGCAAAGATATTTTTGGCAATGGAATGTGATCCGCG

ATAAATGGAATGCCGAATATGATGATATCCACCTGAAAAAAAAGGCCGTGGTGACCGAGAAATATGAAGATGATCGT

CGTAAAAGCTTCAAGAAAATTGGTAGCTTTAGCCTGGAACAGCTGCAAGAATATGCAGATGCAGATCTGAGCGTTGT

GGAAAAAACTGAAAGAAATCATCATTCAGAAGGTGGACGAGATCTATAAAGTTTATGGTAGCAGCGAAAAACTGTTCG

ATGCAGATTTTGTTCTGGAAAAAAGCCTGAAAAAGAATGATGCCGTTGTGGCCATTATGAAAGATCTGCTGGATAGC

GTTAAGAGCTTCGAGAATTACATCAAAGCCTTTTTTGGTGAGGGCAAAGAAACCAATCGTGATGAAAGTTTCTATGG

CGATTTTGTGCTGGCCTATGATATTCTGCTGAAAGTGGACCATATTTATGATGCCATTCGCAATTATGTTACCCAGA

AACCGTATAGCAAAGACAAGTTCAAACTGTACTTTCAGAACCCGCAGTTTATGGGTGGTTGGGATAAAGATAAAGAA

ACCGATTATCGTGCCACCATCCTGCGTTATGGTAGTAAATACTATCTGGCCATCATGGACAAAAAATACGCAAAATG

CCTGCAGAAAATCGACAAAGATGATGTGAATGGCAACTATGAAAAAATCAACTACAAACTGCTGCCTGGTCCGAATA

AAATGCTGCCGAAAGTGTTCTTTAGCAAGAAATGGATGGCCTATTATAACCCGAGCGAGGATATTCAAAAGATCTAC

AAAAATGGCACCTTTAAAAAGGGCGACATGTTCAATCTGAACGATTGCCACAAACTGATCGATTTCTTCAAAGATTC

AATTTCGCGTTATCCGAAATGGTCCAATGCCTATGATTTTAACTTTAGCGAAACCGAAAAATACAAAGACATTGCCG

GTTTTTATCGCGAAGTGGAAGAACAGGGCTATAAAGTGAGCTTTGAAAGCGCAAGCAAAAAAGAGGTTGATAAGCTG

GTTGAAGAGGGCAAACTGTATATGTTCCAGATTTACAACAAAGATTTTAGCGACAAAAGCCATGGCACCCCCGAATCT

GCATACCATGTACTTTAAACTGCTGTTCGACGAAAATAACCATGGTCAGATTCGTCTGAGCGGTGGTGCCGAACTGT

TTATGCGTCGTGCAAGTCTGAAAAAAGAAGAACTGGTTGTTCATCCGGCAAATAGCCCGATTGCAAACAAAAATCCG

GACAATCCGAAAAAAACCACGACACTGAGCTATGATGTGTATAAAGACAAACGTTTTAGCGAGGATCAGTATCTGCT

GCATATCCCGATTGCCATCAATAAATGCCCGAAAAACATCTTTAAGATCAACACCGAAGTTCGCGTGCTGCTGAAAC

ATGATGATAATCCGTATGTGATTGGCATTGATCGTGGTGAACGTAACCTGCTGTATATTGTTGTTGTTGATGGTAAA

GGCAACATCGTGGAACAGTATAGTCTGAACGAAATTATCAACAACTTTAACGGCATCCGCATCAAAACCGACTATCA

TAGCCTGCTGGACAAGAAAGAAAAAGAACGTTTTGAAGCACGTCAGAACTGGACCAGTATTGAAAACATCAAAGAAC

TGAAAGCCGGTTATATTAGCCAGGTGGTTCATAAAATCTGTGAGCTGGTAGAAAAATACGATGCAGTTATTGCACTG

-continued

GAAGATCTGAATAGCGGTTTCAAAAATAGCCGTGTGAAAGTCGAAAAACAGGTGTATCAGAAATTCGAGAAAATGCT
GATCGACAAACTGAACTACATGGTCGACAAAAAAAGCAATCCGTGTGCAACCGGTGGTGCACTGAAAGGTTATCAGA
TTACCAACAAATTTGAAAGCTTTAAAAGCATGAGCACCCAGAACGGCTTTATCTTCTATATTCCGGCATGGCTGACC
AGCAAAATTGATCCGAGCACCGGTTTTGTGAACCTGCTGAAAACAAAATATACCTCCATTGCCGACAGCAAGAAGTT
TATTAGCAGCTTTGATCGCATTATGTATGTTCCGGAAGAGGACCTGTTTGAATTCGCACTGGATTACAAAAATTTCA
GCCGTACCGATGCCGACTACATCAAAAAATGGAAACTGTACAGCTATGGTAACCGCATTCGCATTTTTCGCAACCCG
AAGAAAAACAATGTGTTCGATTGGGAAGAAGTTTGTCTGACCAGCGCATATAAAGAACTTTTCAACAAATACGGCAT
CAACTATCAGCAGGGTGATATTCGTGCACTGCTGTGTGAACAGAGCGATAAAGCGTTTTATAGCAGTTTTATGGCAC
TGATGAGCCTGATGCTGCAGATGCGTAATAGCATTACCGGTCGCACCGATGTGGATTTTCTGATTAGTCCGGTGAAA
AATTCCGATGGCATCTTTTATGATAGCCGCAATTACGAAGCACAAGAAAATGCAATTCTGCCGAAAAACGCAGATGC
AAATGGTGCATATAACATTGCACGTAAAGTTCTGTGGGCAATTGGCCAGTTTAAGAAAGCAGAAGATGAGAAGCTGG
ACAAAGTGAAAATTGCGATCAGCAATAAAGAGTGGCTGGAATACGCACAGACCAGCGTTAAACATGCGCCAGCGCCT
GCTCCTGCACCCGCTCCAGCTCCTGCCCCAGCGATGGTGAGCAAAGGTGAAGAGGATAATATGGCCATCATCAAAGA
ATTCATGCGCTTCAAAGTTCATATGGAAGGTAGCGTTAATGGCCACGAATTTGAAATTGAAGGTGAAGGCGAAGGTC
GTCCGTATGAAGGCACCCAGACCGCAAAACTGAAAGTTACCAAAGGTGGTCCGCTGCCGTTTGCATGGGATATTCTG
AGTCCGCAGTTTATGTATGGTAGCAAAGCCTATGTTAAACATCCGGCAGATATCCCGGATTATCTGAAACTGAGCTT
TCCGGAAGGTTTTAAATGGGAACGTGTGATGAATTTTGAAGATGGTGGTGTTGTTACCGTTACACAGGATAGCAGCC
TGCAGGATGGTGAATTTATCTATAAAGTTAAACTGCGTGGCACGAATTTTCCGAGTGATGGTCCGGTTATGCAGAAA
AAAACCATGGGTTGGGAAGCAAGCAGCGAACGTATGTATCCGGAAGATGGCGCACTGAAAGGTGAAATTAAACAGCG
TCTGAAGCTGAAAGATGGCGGTCATTATGATGCAGAAGTTAAAACCACCTACAAAGCCAAAAAACCGGTTCAGCTGC
CTGGTGCATATAACGTTAACATTAAACTGGATATCACCAGCCACAACGAGGATTATACCATTGTTGAACAGTATGAA
CGTGCAGAAGGTCGCCATAGTACCGGTGGTATGGATGAACTGTATAAA (LbCas12a (E795L)-APAPAPAPAPAPAPAPA-mCherry chimera DNA sequence)

SEQ ID NO: 423

ATGAGCAAACTGGAAAAGTTCACCAACTGTTATAGCCTGAGCAAAACCCTGCGTTTTAAAGCAATTCCGGTTGGTAA
AACCCAAGAGAACATTGATAATAAACGCCTGCTGGTCGAAGATGAAAAACGCGCTGAAGATTATAAAGGCGTGAAAA
AACTGCTGGATCGCTATTATCTGAGCTTCATTAACGATGTGCTGCACAGCATTAAACTGAAGAACCTGAACAACTAT
ATCAGCCTGTTTCGTAAAAAAACCCGCACCGAAAAAGAAAACAAAGAGCTGGAAAACCTGGAAATCAATCTGCGTAA
AGAAATCGCCAAAGCGTTTAAAGGTAACGAGGGTTATAAAAGCCTGTTCAAGAAAGACATCATCGAAACCATTCTGC
CGGAATTTCTGGATGATAAAGATGAAATTGCCCTGGTGAATAGCTTTAATGGCTTTACCACCGCATTTACCGGCTTT
TTTGATAATCGCGAAAACATGTTCAGCGAAGAAGCAAAAAGCACCAGCATTGCATTTCGCTGCATTAATGAAAATCT
GACCCGCTACATTAGCAACATGGATATCTTTGAAAAAGTGGACGCGATCTTCGATAAACACGAAGTGCAAGAGATCA
AAGAGAAAATCCTGAACAGCGATTATGACGTCGAAGATTTTTTTGAAGGCGAGTTCTTTAACTTCGTTCTGACCCAA
GAAGGTATCGACGTTTATAACGCAATTATTGGTGGTTTTGTTACCGAAAGCGGTGAGAAAATCAAAGGCCTGAATGA
ATATATCAACCTGTATAACCAGAAAACCAAACAGAAACTGCCGAAATTCAAACCGCTGTATAAACAGGTTCTGAGCG
ATCGTGAAAGCCTGAGCTTTTATGGTGAAGGTTATACCAGTGATGAAGAGGTTCTGGAAGTTTTTCGTAACACCCTG
AATAAAAACAGCGAGATCTTTAGCAGCATCAAAAAGCTTGAGAAACTGTTCAAAAACTTTGATGAGTATAGCAGCGC
AGGCATCTTTGTTAAAAATGGTCCGGCAATTAGCACCATCAGCAAAGATATTTTTGGCGAATGGAATGTGATCCGCG
ATAAATGGAATGCCGAATATGATGATATCCACCTGAAAAAAAGGCCGTGGTGACCGAGAAATATGAAGATGATCGT
CGTAAAAGCTTCAAGAAAATTGGTAGCTTTAGCCTGGAACAGCTGCAAGAATATGCAGATGCAGATCTGAGCGTTGT
GGAAAAACTGAAAGAAATCATCATTCAGAAGGTGGACGAGATCTATAAAGTTTATGGTAGCAGCGAAAAACTGTTCG
ATGCAGATTTTGTTCTGGAAAAAAGCCTGAAAAAGAATGATGCCGTTGTGGCCATTATGAAAGATCTGCTGGATAGC

-continued

```
GTTAAGAGCTTCGAGAATTACATCAAAGCCTTTTTTGGTGAGGGCAAAGAAACCAATCGTGATGAAAGTTTCTATGG
CGATTTTGTGCTGGCCTATGATATTCTGCTGAAAGTGGACCATATTTATGATGCCATTCGCAATTATGTTACCCAGA
AACCGTATAGCAAAGACAAGTTCAAACTGTACTTTCAGAACCCGCAGTTTATGGGTGGTTGGGATAAAGATAAAGAA
ACCGATTATCGTGCCACCATCCTGCGTTATGGTAGTAAATACTATCTGGCCATCATGGACAAAAAATACGCAAAATG
CCTGCAGAAAATCGACAAAGATGATGTGAATGGCAACTATGAAAAAATCAACTACAAACTGCTGCCTGGTCCGAATA
AAATGCTGCCGAAAGTGTTCTTTAGCAAGAAATGGATGGCCTATTATAACCCGAGCGAGGATATTCAAAAGATCTAC
AAAAATGGCACCTTTAAAAAGGGCGACATGTTCAATCTGAACGATTGCCACAAACTGATCGATTTCTTCAAAGATTC
AATTTCGCGTTATCCGAAATGGTCCAATGCCTATGATTTTAACTTTAGCGAAACCGAAAAATACAAAGACATTGCCG
GTTTTTATCGCGAAGTGGAAGAACAGGGCTATAAAGTGAGCTTTGAAAGCGCAAGCAAAAAGAGGTTGATAAGCTG
GTTGAAGAGGGCAAACTGTATATGTTCCAGATTTACAACAAAGATTTTAGCGACAAAAGCCATGGCACCCCGAATCT
GCATACCATGTACTTTAAACTGCTGTTCGACGAAAATAACCATGGTCAGATTCGTCTGAGCGGTGGTGCCGAACTGT
TTATGCGTCGTGCAAGTCTGAAAAAAGAAGAACTGGTTGTTCATCCGGCAAATAGCCCGATTGCAAACAAAAATCCG
GACAATCCGAAAAAAACCACGACACTGAGCTATGATGTGTATAAAGACAAACGTTTTAGCGAGGATCAGTATCTGCT
GCATATCCCGATTGCCATCAATAAATGCCCGAAAAACATCTTTAAGATCAACACCGAAGTTCGCGTGCTGCTGAAAC
ATGATGATAATCCGTATGTGATTGGCATTGATCGTGGTGAACGTAACCTGCTGTATATTGTTGTTGTTGATGGTAAA
GGCAACATCGTGGAACAGTATAGTCTGAACGAAATTATCAACAACTTTAACGGCATCCGCATCAAAACCGACTATCA
TAGCCTGCTGGACAAGAAAGAAAAGAACGTTTTGAAGCACGTCAGAACTGGACCAGTATTGAAAACATCAAAGAAC
TGAAAGCCGGTTATATTAGCCAGGTGGTTCATAAAATCTGTGAGCTGGTAGAAAAATACGATGCAGTTATTGCACTG
GAAGATCTGAATAGCGGTTTCAAAAATAGCCGTGTGAAAGTCGAAAAACAGGTGTATCAGAAATTCGAGAAAATGCT
GATCGACAAACTGAACTACATGGTCGACAAAAAAAGCAATCCGTGTGCAACCGGTGGTGCACTGAAAGGTTATCAGA
TTACCAACAAATTTGAAAGCTTTAAAAGCATGAGCACCCAGAACGGCTTTATCTTCTATATTCCGGCATGGCTGACC
AGCAAAATTGATCCGAGCACCGGTTTTGTGAACCTGCTGAAAACAAAATATACCTCCATTGCCGACAGCAAGAAGTT
TATTAGCAGCTTTGATCGCATTATGTATGTTCCGGAAGAGGACCTGTTTGAATTCGCACTGGATTACAAAAATTTCA
GCCGTACCGATGCCGACTACATCAAAAAATGGAAACTGTACAGCTATGGTAACCGCATTCGCATTTTTCGCAACCCG
AAGAAAAACAATGTGTTCGATTGGGAAGAAGTTTGTCTGACCAGCGCATATAAAGAACTTTTCAACAAATACGGCAT
CAACTATCAGCAGGGTGATATTCGTGCACTGCTGTGTGAACAGAGCGATAAAGCGTTTTATAGCAGTTTTATGGCAC
TGATGAGCCTGATGCTGCAGATGCGTAATAGCATTACCGGTCGCACCGATGTGGATTTTCTGATTAGTCCGGTGAAA
AATTCCGATGGCATCTTTTATGATAGCCGCAATTACGAAGCACAAGAAATGCAATTCTGCCGAAAAACGCAGATGC
AAATGGTGCATATAACATTGCACGTAAAGTTCTGTGGGCAATTGGCCAGTTTAAGAAAGCAGAAGATGAGAAGCTGG
ACAAAGTGAAAATTGCGATCAGCAATAAAGAGTGGCTGGAATACGCACAGACCAGCGTTAAACATGCGCCAGCGCCT
GCTCCTGCACCCGCTCCAGCGCCAGCTCCTGCACCTGCGATGGTGAGCAAAGGTGAAGAGGATAATATGGCCATCAT
CAAAGAATTCATGCGCTTCAAAGTTCATATGGAAGGTAGCGTTAATGGCCACGAATTTGAAATTGAAGGTGAAGGCG
AAGGTCGTCCGTATGAAGGCACCCAGACCGCAAAACTGAAAGTTACCAAAGGTGGTCCGCTGCCGTTTGCATGGGAT
ATTCTGAGTCCGCAGTTTATGTATGGTAGCAAAGCCTATGTTAAACATCCGGCAGATATCCCGGATTATCTGAAACT
GAGCTTTCCGGAAGGTTTTAAATGGGAACGTGTGATGAATTTTGAAGATGGTGGTGTTGTTACCGTTACACAGGATA
GCAGCCTGCAGGATGGTGAATTTATCTATAAAGTTAAACTGCGTGGCACGAATTTTCCGAGTGATGGTCCGGTTATG
CAGAAAAAAACCATGGGTTGGGAAGCAAGCAGCGAACGTATGTATCCGGAAGATGGCGCACTGAAAGGTGAAATTAA
ACAGCGTCTGAAGCTGAAAGATGGCGGTCATTATGATGCAGAAGTTAAAACCACCTACAAAGCCAAAAAACCGGTTC
AGCTGCCTGGTGCATATAACGTTAACATTAAACTGGATATCACCAGCCACAACGAGGATTATACCATTGTTGAACAG
TATGAACGTGCAGAAGGTCGCCATAGTACCGGTGGTATGGATGAACTGTATAAA
```

-continued (LbCas12a (E795L)-APAPAPAPAPAPAPAPAPAPA-mCherry chimera DNA sequence)

SEQ ID NO: 424

ATGAGCAAACTGGAAAAGTTCACCAACTGTTATAGCCTGAGCAAAACCCTGCGTTTTAAAGCAATTCCGGTTGGTAA
AACCCAAGAGAACATTGATAATAAACGCCTGCTGGTCGAAGATGAAAAACGCGCTGAAGATTATAAAGGCGTGAAAA
AACTGCTGGATCGCTATTATCTGAGCTTCATTAACGATGTGCTGCACAGCATTAAACTGAAGAACCTGAACAACTAT
ATCAGCCTGTTTCGTAAAAAAACCCGCACCGAAAAAGAAAACAAAGAGCTGGAAAACCTGGAAATCAATCTGCGTAA
AGAAATCGCCAAAGCGTTTAAAGGTAACGAGGGTTATAAAAGCCTGTTCAAGAAAGACATCATCGAAACCATTCTGC
CGGAATTTCTGGATGATAAAGATGAAATTGCCCTGGTGAATAGCTTTAATGGCTTTACCACCGCATTTACCGGCTTT
TTTGATAATCGCGAAAACATGTTCAGCGAAGAAGCAAAAAGCACCAGCATTGCATTTCGCTGCATTAATGAAAATCT
GACCCGCTACATTAGCAACATGGATATCTTTGAAAAAGTGGACGCGATCTTCGATAAACACGAAGTGCAAGAGATCA
AAGAGAAAATCCTGAACAGCGATTATGACGTCGAAGATTTTTTTGAAGGCGAGTTCTTTAACTTCGTTCTGACCCAA
GAAGGTATCGACGTTTATAACGCAATTATTGGTGGTTTTGTTACCGAAAGCGGTGAGAAAATCAAAGGCCTGAATGA
ATATATCAACCTGTATAACCAGAAAACCAAACAGAAACTGCCGAAATTCAAACCGCTGTATAAACAGGTTCTGAGCG
ATCGTGAAAGCCTGAGCTTTTATGGTGAAGGTTATACCAGTGATGAAGAGGTTCTGGAAGTTTTTCGTAACACCCTG
AATAAAAACAGCGAGATCTTTAGCAGCATCAAAAAGCTTGAGAAACTGTTCAAAAACTTTGATGAGTATAGCAGCGC
AGGCATCTTTGTTAAAAATGGTCCGGCAATTAGCACCATCAGCAAAGATATTTTTGGCGAATGGAATGTGATCCGCG
ATAAATGGAATGCCGAATATGATGATATCCACCTGAAAAAAAAGGCCGTGGTGACCGAGAAATATGAAGATGATCGT
CGTAAAAGCTTCAAGAAAATTGGTAGCTTTAGCCTGGAACAGCTGCAAGAATATGCAGATGCAGATCTGAGCGTTGT
GGAAAAAACTGAAAGAAATCATCATTCAGAAGGTGGACGAGATCTATAAAGTTTATGGTAGCAGCGAAAAACTGTTCG
ATGCAGATTTTGTTCTGGAAAAAAGCCTGAAAAAGAATGATGCCGTTGTGGCCATTATGAAAGATCTGCTGGATAGC
GTTAAGAGCTTCGAGAATTACATCAAAGCCTTTTTTGGTGAGGGCAAAGAAACCAATCGTGATGAAAGTTTCTATGG
CGATTTTGTGCTGGCCTATGATATTCTGCTGAAAGTGGACCATATTTATGATGCCATTCGCAATTATGTTACCCAGA
AACCGTATAGCAAAGACAAGTTCAAACTGTACTTTCAGAACCCGCAGTTTATGGGTGGTTGGGATAAAGATAAAGAA
ACCGATTATCGTGCCACCATCCTGCGTTATGGTAGTAAATACTATCTGGCCATCATGGACAAAAAATACGCAAAATG
CCTGCAGAAAATCGACAAAGATGATGTGAATGGCAACTATGAAAAAATCAACTACAAACTGCTGCCTGGTCCGAATA
AAATGCTGCCGAAAGTGTTCTTTAGCAAGAAATGGATGGCCTATTATAACCCGAGCGAGGATATTCAAAAGATCTAC
AAAAATGGCACCTTTAAAAAGGGCGACATGTTCAATCTGAACGATTGCCACAAACTGATCGATTTCTTCAAAGATTC
AATTTCGCGTTATCCGAAATGGTCCAATGCCTATGATTTTAACTTTAGCGAAACCGAAAAATACAAAGACATTGCCG
GTTTTTATCGCGAAGTGGAAGAACAGGGCTATAAAGTGAGCTTTGAAAGCGCAAGCAAAAAGGAGGTTGATAAGCTG
GTTGAAGAGGGCAAACTGTATATGTTCCAGATTTACAACAAAGATTTTAGCGACAAAAGCCATGGCACCCCCGAATCT
GCATACCATGTACTTTAAACTGCTGTTCGACGAAAATAACCATGGTCAGATTCGTCTGAGCGGTGGTGCCGAACTGT
TTATGCGTCGTGCAAGTCTGAAAAAAGAAGAACTGGTTGTTCATCCGGCAAATAGCCCGATTGCAAACAAAAATCCG
GACAATCCGAAAAAAACCACGACACTGAGCTATGATGTGTATAAAGACAAACGTTTTAGCGAGGATCAGTATCTGCT
GCATATCCCGATTGCCATCAATAAATGCCCGAAAAACATCTTTAAGATCAACACCGAAGTTCGCGTGCTGCTGAAAC
ATGATGATAATCCGTATGTGATTGGCATTGATCGTGGTGAACGTAACCTGCTGTATATTGTTGTTGTTGATGGTAAA
GGCAACATCGTGGAACAGTATAGTCTGAACGAAATTATCAACAACTTTAACGGCATCCGCATCAAAACCGACTATCA
TAGCCTGCTGGACAAGAAAGAAAAAGAACGTTTTGAAGCACGTCAGAACTGGACCAGTATTGAAAACATCAAAGAAC
TGAAAGCCGGTTATATTAGCCAGGTGGTTCATAAAATCTGTGAGCTGGTAGAAAAATACGATGCAGTTATTGCACTG
GAAGATCTGAATAGCGGTTTCAAAAATAGCCGTGTGAAAGTCGAAAAACAGGTGTATCAGAAATTCGAGAAAATGCT
GATCGACAAACTGAACTACATGGTCGACAAAAAAAGCAATCCGTGTGCAACCGGTGGTGCACTGAAAGGTTATCAGA
TTACCAACAAATTTGAAAGCTTTAAAAGCATGAGCACCCAGAACGGCTTTATCTTCTATATTCCGGCATGGCTGACC
AGCAAAATTGATCCGAGCACCGGTTTTGTGAACCTGCTGAAAACAAAATATACCTCCATTGCCGACAGCAAGAAGTT

```
TATTAGCAGCTTTGATCGCATTATGTATGTTCCGGAAGAGGACCTGTTTGAATTCGCACTGGATTACAAAAATTTCA
GCCGTACCGATGCCGACTACATCAAAAAATGGAAACTGTACAGCTATGGTAACCGCATTCGCATTTTTCGCAACCCG
AAGAAAAACAATGTGTTCGATTGGGAAGAAGTTTGTCTGACCAGCGCATATAAAGAACTTTTCAACAAATACGGCAT
CAACTATCAGCAGGGTGATATTCGTGCACTGCTGTGTGAACAGAGCGATAAAGCGTTTTATAGCAGTTTTATGGCAC
TGATGAGCCTGATGCTGCAGATGCGTAATAGCATTACCGGTCGCACCGATGTGGATTTTCTGATTAGTCCGGTGAAA
AATTCCGATGGCATCTTTTATGATAGCCGCAATTACGAAGCACAAGAAAATGCAATTCTGCCGAAAAACGCAGATGC
AAATGGTGCATATAACATTGCACGTAAAGTTCTGTGGGCAATTGGCCAGTTTAAGAAAGCAGAAGATGAGAAGCTGG
ACAAAGTGAAAATTGCGATCAGCAATAAAGAGTGGCTGGAATACGCACAGACCAGCGTTAAACATGCGCCAGCGCCT
GCTCCTGCACCCGCTCCAGCTCCTGCGCCAGCTCCTGCACCTGCGATGGTGAGCAAAGGTGAAGAGGATAATATGGC
CATCATCAAAGAATTCATGCGCTTCAAAGTTCATATGGAAGGTAGCGTTAATGGCCACGAATTTGAAATTGAAGGTG
AAGGCGAAGGTCGTCCGTATGAAGGCACCCAGACCGCAAAACTGAAAGTTACCAAAGGTGGTCCGCTGCCGTTTGCA
TGGGATATTCTGAGTCCGCAGTTTATGTATGGTAGCAAAGCCTATGTTAAACATCCGGCAGATATCCCGGATTATCT
GAAACTGAGCTTTCCGGAAGGTTTTAAATGGGAACGTGTGATGAATTTTGAAGATGGTGGTGTTGTTACCGTTACAC
AGGATAGCAGCCTGCAGGATGGTGAATTTATCTATAAAGTTAAACTGCGTGGCACGAATTTTCCGAGTGATGGTCCG
GTTATGCAGAAAAAAACCATGGGTTGGGAAGCAAGCAGCGAACGTATGTATCCGGAAGATGGCGCACTGAAAGGTGA
AATTAAACAGCGTCTGAAGCTGAAAGATGGCGGTCATTATGATGCAGAAGTTAAAACCACCTACAAAGCCAAAAAAC
CGGTTCAGCTGCCTGGTGCATATAACGTTAACATTAAACTGGATATCACCAGCCACAACGAGGATTATACCATTGTT
GAACAGTATGAACGTGCAGAAGGTCGCCATAGTACCGGTGGTATGGATGAACTGTATAAA
```

(LbCas12a (E795L)-APAPAPAPAPAPAPAPAPAPAPA-mCherry chimera DNA sequence)

SEQ ID NO: 425

```
ATGAGCAAACTGGAAAAGTTCACCAACTGTTATAGCCTGAGCAAAACCCTGCGTTTTAAAGCAATTCCGGTTGGTAA
AACCCAAGAGAACATTGATAATAAACGCCTGCTGGTCGAAGATGAAAAACGCGCTGAAGATTATAAAGGCGTGAAAA
AACTGCTGGATCGCTATTATCTGAGCTTCATTAACGATGTGCTGCACAGCATTAAACTGAAGAACCTGAACAACTAT
ATCAGCCTGTTTCGTAAAAAAACCCGCACCGAAAAGAAAACAAAGAGCTGGAAAACCTGGAAATCAATCTGCGTAA
AGAAATCGCCAAAGCGTTTAAAGGTAACGAGGGTTATAAAAGCCTGTTCAAGAAAGACATCATCGAAACCATTCTGC
CGGAATTTCTGGATGATAAAGATGAAATTGCCCTGGTGAATAGCTTTAATGGCTTTACCACCGCATTTACCGGCTTT
TTTGATAATCGCGAAAACATGTTCAGCGAAGAAGCAAAAAGCACCAGCATTGCATTTCGCTGCATTAATGAAAATCT
GACCCGCTACATTAGCAACATGGATATCTTTGAAAAAGTGGACGCGATCTTCGATAAACACGAAGTGCAAGAGATCA
AAGAGAAAATCCTGAACAGCGATTATGACGTCGAAGATTTTTTTGAAGGCGAGTTCTTTAACTTCGTTCTGACCCAA
GAAGGTATCGACGTTTATAACGCAATTATTGGTGGTTTTGTTACCGAAAGCGGTGAGAAAATCAAAGGCCTGAATGA
ATATATCAACCTGTATAACCAGAAAACCAAACAGAAACTGCCGAAATTCAAACCGCTGTATAAACAGGTTCTGAGCG
ATCGTGAAAGCCTGAGCTTTTATGGTGAAGGTTATACCAGTGATGAAGAGGTTCTGGAAGTTTTTCGTAACACCCTG
AATAAAAACAGCGAGATCTTTAGCAGCATCAAAAAGCTTGAGAAACTGTTCAAAAACTTTGATGAGTATAGCAGCGC
AGGCATCTTTGTTAAAAATGGTCCGGCAATTAGCACCATCAGCAAAGATATTTTTGGCGAATGGAATGTGATCCGCG
ATAAATGGAATGCCGAATATGATGATATCCACCTGAAAAAAAGGCCGTGGTGACCGAGAAATATGAAGATGATCGT
CGTAAAAGCTTCAAGAAAATTGGTAGCTTTAGCCTGGAACAGCTGCAAGAATATGCAGATGCAGATCTGAGCGTTGT
GGAAAAACTGAAAGAAATCATCATTCAGAAGGTGGACGAGATCTATAAAGTTTATGGTAGCAGCGAAAAACTGTTCG
ATGCAGATTTTGTTCTGGAAAAAAAGCCTGAAAAAGAATGATGCCGTTGTGGCCATTATGAAAGATCTGCTGGATAGC
GTTAAGAGCTTCGAGAATTACATCAAAGCCTTTTTTGGTGAGGGCAAAGAAACCAATCGTGATGAAAGTTTCTATGG
CGATTTTGTGCTGGCCTATGATATTCTGCTGAAAGTGGACCATATTTATGATGCCATTCGCAATTATGTTACCCAGA
AACCGTATAGCAAAGACAAGTTCAAACTGTACTTTCAGAACCCGCAGTTTATGGGTGGTTGGGATAAAGATAAAGAA
```

-continued

ACCGATTATCGTGCCACCATCCTGCGTTATGGTAGTAAATACTATCTGGCCATCATGGACAAAAATACGCAAATG

CCTGCAGAAAATCGACAAAGATGATGTGAATGGCAACTATGAAAAAATCAACTACAAACTGCTGCCTGGTCCGAATA

AAATGCTGCCGAAAGTGTTCTTTAGCAAGAAATGGATGGCCTATTATAACCCGAGCGAGGATATTCAAAAGATCTAC

AAAAATGGCACCTTTAAAAAGGGCGACATGTTCAATCTGAACGATTGCCACAAACTGATCGATTTCTTCAAAGATTC

AATTTCGCGTTATCCGAAATGGTCCAATGCCTATGATTTTAACTTTAGCGAAACCGAAAAATACAAAGACATTGCCG

GTTTTTATCGCGAAGTGGAAGAACAGGGCTATAAAGTGAGCTTTGAAAGCGCAAGCAAAAAGAGGTTGATAAGCTG

GTTGAAGAGGGCAAACTGTATATGTTCCAGATTTACAACAAAGATTTTAGCGACAAAAGCCATGGCACCCCGAATCT

GCATACCATGTACTTTAAACTGCTGTTCGACGAAAATAACCATGGTCAGATTCGTCTGAGCGGTGGTGCCGAACTGT

TTATGCGTCGTGCAAGTCTGAAAAAGAAGAACTGGTTGTTCATCCGGCAAATAGCCCGATTGCAAACAAAAATCCG

GACAATCCGAAAAAACCACGACACTGAGCTATGATGTGTATAAAGACAAACGTTTTAGCGAGGATCAGTATCTGCT

GCATATCCCGATTGCCATCAATAAATGCCCGAAAAACATCTTTAAGATCAACACCGAAGTTCGCGTGCTGCTGAAAC

ATGATGATAATCCGTATGTGATTGGCATTGATCGTGGTGAACGTAACCTGCTGTATATTGTTGTTGTTGATGGTAAA

GGCAACATCGTGGAACAGTATAGTCTGAACGAAATTATCAACAACTTTAACGGCATCCGCATCAAAACCGACTATCA

TAGCCTGCTGGACAAGAAAGAAAAAGAACGTTTTGAAGCACGTCAGAACTGGACCAGTATTGAAAACATCAAAGAAC

TGAAAGCCGGTTATATTAGCCAGGTGGTTCATAAAATCTGTGAGCTGGTAGAAAAATACGATGCAGTTATTGCACTG

GAAGATCTGAATAGCGGTTTCAAAAATAGCCGTGTGAAAGTCGAAAAACAGGTGTATCAGAAATTCGAGAAAATGCT

GATCGACAAACTGAACTACATGGTCGACAAAAAAAGCAATCCGTGTGCAACCGGTGGTGCACTGAAAGGTTATCAGA

TTACCAACAAATTTGAAAGCTTTAAAAGCATGAGCACCCAGAACGGCTTTATCTTCTATATTCCGGCATGGCTGACC

AGCAAAATTGATCCGAGCACCGGTTTTGTGAACCTGCTGAAAACAAAATATACCTCCATTGCCGACAGCAAGAAGTT

TATTAGCAGCTTTGATCGCATTATGTATGTTCCGGAAGAGGACCTGTTTGAATTCGCACTGGATTACAAAAATTTCA

GCCGTACCGATGCCGACTACATCAAAAAATGGAAACTGTACAGCTATGGTAACCGCATTCGCATTTTTCGCAACCCG

AAGAAAAACAATGTGTTCGATTGGGAAGAAGTTTGTCTGACCAGCGCATATAAAGAACTTTTCAACAAATACGGCAT

CAACTATCAGCAGGGTGATATTCGTGCACTGCTGTGTGAACAGAGCGATAAAGCGTTTTATAGCAGTTTTATGGCAC

TGATGAGCCTGATGCTGCAGATGCGTAATAGCATTACCGGTCGCACCGATGTGGATTTTCTGATTAGTCCGGTGAAA

AATTCCGATGGCATCTTTTATGATAGCCGCAATTACGAAGCACAAGAAAATGCAATTCTGCCGAAAAACGCAGATGC

AAATGGTGCATATAACATTGCACGTAAAGTTCTGTGGGCAATTGGCCAGTTTAAGAAAGCAGAAGATGAGAAGCTGG

ACAAAGTGAAAATTGCGATCAGCAATAAAGAGTGGCTGGAATACGCACAGACCAGCGTTAAACATGCGCCAGCGCCT

GCTCCTGCACCCGCTCCAGCTCCTGCTCCTGCGCCAGCTCCTGCACCTGCGATGGTGAGCAAAGGTGAAGAGGATAA

TATGGCCATCATCAAAGAATTCATGCGCTTCAAAGTTCATATGGAAGGTAGCGTTAATGGCCACGAATTTGAAATTG

AAGGTGAAGGCGAAGGTCGTCCGTATGAAGGCACCCAGACCGCAAAACTGAAAGTTACCAAAGGTGGTCCGCTGCCG

TTTGCATGGGATATTCTGAGTCCGCAGTTTATGTATGGTAGCAAAGCCTATGTTAAACATCCGGCAGATATCCCGGA

TTATCTGAAACTGAGCTTTCCGGAAGGTTTTAAATGGGAACGTGTGATGAATTTTGAAGATGGTGGTGTTGTTACCG

TTACACAGGATAGCAGCCTGCAGGATGGTGAATTTATCTATAAAGTTAAACTGCGTGGCACGAATTTTCCGAGTGAT

GGTCCGGTTATGCAGAAAAAAACCATGGGTTGGGAAGCAAGCAGCGAACGTATGTATCCGGAAGATGGCGCACTGAA

AGGTGAAATTAAACAGCGTCTGAAGCTGAAAGATGGCGGTCATTATGATGCAGAAGTTAAAACCACCTACAAAGCCA

AAAAACCGGTTCAGCTGCCTGGTGCATATAACGTTAACATTAAACTGGATATCACCAGCCACAACGAGGATTATACC

ATTGTTGAACAGTATGAACGTGCAGAAGGTCGCCATAGTACCGGTGGTATGGATGAACTGTATAAA (LbCas12a (E795L)-APAPAPAPAPAPAPAPAPAPAPAPA-mCherry chimera DNA sequence)

SEQ ID NO: 426

ATGAGCAAACTGGAAAAGTTCACCAACTGTTATAGCCTGAGCAAAACCCTGCGTTTTAAAGCAATTCCGGTTGGTAA

AACCCAAGAGAACATTGATAATAAACGCCTGCTGGTCGAAGATGAAAAACGCGCTGAAGATTATAAAGGCGTGAAAA

AACTGCTGGATCGCTATTATCTGAGCTTCATTAACGATGTGCTGCACAGCATTAAACTGAAGAACCTGAACAACTAT

-continued

```
ATCAGCCTGTTTCGTAAAAAAACCCGCACCGAAAAGAAAACAAAGAGCTGGAAAACCTGGAAATCAATCTGCGTAA

AGAAATCGCCAAAGCGTTTAAAGGTAACGAGGGTTATAAAAGCCTGTTCAAGAAAGACATCATCGAAACCATTCTGC

CGGAATTTCTGGATGATAAAGATGAAATTGCCCTGGTGAATAGCTTTAATGGCTTTACCACCGCATTTACCGGCTTT

TTTGATAATCGCGAAAACATGTTCAGCGAAGAAGCAAAAAGCACCAGCATTGCATTTCGCTGCATTAATGAAATCT

GACCCGCTACATTAGCAACATGGATATCTTTGAAAAAGTGGACGCGATCTTCGATAAACACGAAGTGCAAGAGATCA

AAGAGAAAATCCTGAACAGCGATTATGACGTCGAAGATTTTTTTGAAGGCGAGTTCTTTAACTTCGTTCTGACCCAA

GAAGGTATCGACGTTTATAACGCAATTATTGGTGGTTTTGTTACCGAAAGCGGTGAGAAAATCAAAGGCCTGAATGA

ATATATCAACCTGTATAACCAGAAAACCAAACAGAAACTGCCGAAATTCAAACCGCTGTATAAACAGGTTCTGAGCG

ATCGTGAAAGCCTGAGCTTTTATGGTGAAGGTTATACCAGTGATGAAGAGGTTCTGGAAGTTTTTCGTAACACCCTG

AATAAAAACAGCGAGATCTTTAGCAGCATCAAAAAGCTTGAGAAACTGTTCAAAAACTTTGATGAGTATAGCAGCGC

AGGCATCTTTGTTAAAAATGGTCCGGCAATTAGCACCATCAGCAAAGATATTTTTGGCGAATGGAATGTGATCCGCG

ATAAATGGAATGCCGAATATGATGATATCCACCTGAAAAAAAAGGCCGTGGTGACCGAGAAATATGAAGATGATCGT

CGTAAAAGCTTCAAGAAAATTGGTAGCTTTAGCCTGGAACAGCTGCAAGAATATGCAGATGCAGATCTGAGCGTTGT

GGAAAAAACTGAAAGAAATCATCATTCAGAAGGTGGACGAGATCTATAAAGTTTATGGTAGCAGCGAAAAACTGTTCG

ATGCAGATTTTGTTCTGGAAAAAAGCCTGAAAAAGAATGATGCCGTTGTGGCCATTATGAAAGATCTGCTGGATAGC

GTTAAGAGCTTCGAGAATTACATCAAAGCCTTTTTTGGTGAGGGCAAAGAAACCAATCGTGATGAAAGTTTCTATGG

CGATTTTGTGCTGGCCTATGATATTCTGCTGAAAGTGGACCATATTTATGATGCCATTCGCAATTATGTTACCCAGA

AACCGTATAGCAAAGACAAGTTCAAACTGTACTTTCAGAACCCGCAGTTTATGGGTGGTTGGGATAAAGATAAAGAA

ACCGATTATCGTGCCACCATCCTGCGTTATGGTAGTAAATACTATCTGGCCATCATGGACAAAAAATACGCAAAATG

CCTGCAGAAAATCGACAAAGATGATGTGAATGGCAACTATGAAAAAATCAACTACAAACTGCTGCCTGGTCCGAATA

AAATGCTGCCGAAAGTGTTCTTTAGCAAGAAATGGATGGCCTATTATAACCCGAGCGAGGATATTCAAAAGATCTAC

AAAAATGGCACCTTTAAAAAGGGCGACATGTTCAATCTGAACGATTGCCACAAACTGATCGATTTCTTCAAAGATTC

AATTTCGCGTTATCCGAAATGGTCCAATGCCTATGATTTTAACTTTAGCGAAACCGAAAAATACAAAGACATTGCCG

GTTTTTATCGCGAAGTGGAAGAACAGGGCTATAAAGTGAGCTTTGAAAGCGCAAGCAAAAAAGAGGTTGATAAGCTG

GTTGAAGAGGGCAAACTGTATATGTTCCAGATTTACAACAAAGATTTTAGCGACAAAAGCCATGGCACCCCGAATCT

GCATACCATGTACTTTAAACTGCTGTTCGACGAAAATAACCATGGTCAGATTCGTCTGAGCGGTGGTGCCGAACTGT

TTATGCGTCGTGCAAGTCTGAAAAAAGAAGAACTGGTTGTTCATCCGGCAAATAGCCCGATTGCAAACAAAAATCCG

GACAATCCGAAAAAAACCACGACACTGAGCTATGATGTGTATAAAGACAAACGTTTTAGCGAGGATCAGTATCTGCT

GCATATCCCGATTGCCATCAATAAATGCCCGAAAAACATCTTTAAGATCAACACCGAAGTTCGCGTGCTGCTGAAAC

ATGATGATAATCCGTATGTGATTGGCATTGATCGTGGTGAACGTAACCTGCTGTATATTGTTGTTGTTGATGGTAAA

GGCAACATCGTGGAACAGTATAGTCTGAACGAAATTATCAACAACTTTAACGGCATCCGCATCAAAACCGACTATCA

TAGCCTGCTGGACAAGAAAGAAAAAGAACGTTTTGAAGCACGTCAGAACTGGACCAGTATTGAAAACATCAAAGAAC

TGAAAGCCGGTTATATTAGCCAGGTGGTTCATAAAATCTGTGAGCTGGTAGAAAAATACGATGCAGTTATTGCACTG

GAAGATCTGAATAGCGGTTTCAAAAATAGCCGTGTGAAAGTCGAAAAACAGGTGTATCAGAAATTCGAGAAAATGCT

GATCGACAAACTGAACTACATGGTCGACAAAAAAGCAATCCGTGTGCAACCGGTGGTGCACTGAAAGGTTATCAGA

TTACCAACAAATTTGAAAGCTTTAAAAGCATGAGCACCCAGAACGGCTTTATCTTCTATATTCCGGCATGGCTGACC

AGCAAAATTGATCCGAGCACCGGTTTTGTGAACCTGCTGAAAACAAAATATACCTCCATTGCCGACAGCAAGAAGTT

TATTAGCAGCTTTGATCGCATTATGTATGTTCCGGAAGAGGACCTGTTTGAATTCGCACTGGATTACAAAAATTTCA

GCCGTACCGATGCCGACTACATCAAAAAATGGAAACTGTACAGCTATGGTAACCGCATTCGCATTTTTCGCAACCCG

AAGAAAAACAATGTGTTCGATTGGGAAGAAGTTTGTCTGACCAGCGCATATAAAGAACTTTTCAACAAATACGGCAT
```

-continued

CAACTATCAGCAGGGTGATATTCGTGCACTGCTGTGTGAACAGAGCGATAAAGCGTTTTATAGCAGTTTTATGGCAC

TGATGAGCCTGATGCTGCAGATGCGTAATAGCATTACCGGTCGCACCGATGTGGATTTTCTGATTAGTCCGGTGAAA

AATTCCGATGGCATCTTTTATGATAGCCGCAATTACGAAGCACAAGAAAATGCAATTCTGCCGAAAAACGCAGATGC

AAATGGTGCATATAACATTGCACGTAAAGTTCTGTGGGCAATTGGCCAGTTTAAGAAAGCAGAAGATGAGAAGCTGG

ACAAAGTGAAAATTGCGATCAGCAATAAAGAGTGGCTGGAATACGCACAGACCAGCGTTAAACATGCGCCAGCGCCT

GCTCCTGCACCCGCTCCAGCTCCTGCCCCAGCTCCAGCGCCCGCTCCTGCACCTGCGATGGTGAGCAAAGGTGAAGA

GGATAATATGGCCATCATCAAAGAATTCATGCGCTTCAAAGTTCATATGGAAGGTAGCGTTAATGGCCACGAATTTG

AAATTGAAGGTGAAGGCGAAGGTCGTCCGTATGAAGGCACCCAGACCGCAAAACTGAAAGTTACCAAAGGTGGTCCG

CTGCCGTTTGCATGGGATATTCTGAGTCCGCAGTTTATGTATGGTAGCAAAGCCTATGTTAAACATCCGGCAGATAT

CCCGGATTATCTGAAACTGAGCTTTCCGGAAGGTTTTAAATGGGAACGTGTGATGAATTTTGAAGATGGTGGTGTTG

TTACCGTTACACAGGATAGCAGCCTGCAGGATGGTGAATTTATCTATAAAGTTAAACTGCGTGGCACGAATTTTCCG

AGTGATGGTCCGGTTATGCAGAAAAAAACCATGGGTTGGGAAGCAAGCAGCGAACGTATGTATCCGGAAGATGGCGC

ACTGAAAGGTGAAATTAAACAGCGTCTGAAGCTGAAAGATGGCGGTCATTATGATGCAGAAGTTAAAACCACCTACA

AAGCCAAAAAACCGGTTCAGCTGCCTGGTGCATATAACGTTAACATTAAACTGGATATCACCAGCCACAACGAGGAT

TATACCATTGTTGAACAGTATGAACGTGCAGAAGGTCGCCATAGTACCGGTGGTATGGATGAACTGTATAAA (LbCas12a (E795L)-APAPAPAPAPAPAPAPAPAPAPAPAPAPA-mCherry chimera DNA sequence)

SEQ ID NO: 427

ATGAGCAAACTGGAAAAGTTCACCAACTGTTATAGCCTGAGCAAAACCCTGCGTTTTAAAGCAATTCCGGTTGGTAA

AACCCAAGAGAACATTGATAATAAACGCCTGCTGGTCGAAGATGAAAAACGCGCTGAAGATTATAAAGGCGTGAAAA

AACTGCTGGATCGCTATTATCTGAGCTTCATTAACGATGTGCTGCACAGCATTAAACTGAAGAACCTGAACAACTAT

ATCAGCCTGTTTCGTAAAAAAACCCGCACCGAAAAAGAAAACAAAGAGCTGGAAAACCTGGAAATCAATCTGCGTAA

AGAAATCGCCAAAGCGTTTAAAGGTAACGAGGGTTATAAAAGCCTGTTCAAGAAAGACATCATCGAAACCATTCTGC

CGGAATTTCTGGATGATAAAGATGAAATTGCCCTGGTGAATAGCTTTAATGGCTTTACCACCGCATTTACCGGCTTT

TTTGATAATCGCGAAAACATGTTCAGCGAAGAAGCAAAAAGCACCAGCATTGCATTTCGCTGCATTAATGAAAATCT

GACCCGCTACATTAGCAACATGGATATCTTTGAAAAAGTGGACGCGATCTTCGATAAACACGAAGTGCAAGAGATCA

AAGAGAAAATCCTGAACAGCGATTATGACGTCGAAGATTTTTTTGAAGGCGAGTTCTTTAACTTCGTTCTGACCCAA

GAAGGTATCGACGTTTATAACGCAATTATTGGTGGTTTTGTTACCGAAAGCGGTGAGAAAATCAAAGGCCTGAATGA

ATATATCAACCTGTATAACCAGAAAACCAAACAGAAACTGCCGAAATTCAAACCGCTGTATAAACAGGTTCTGAGCG

ATCGTGAAAGCCTGAGCTTTTATGGTGAAGGTTATACCAGTGATGAAGAGGTTCTGGAAGTTTTTCGTAACACCCTG

AATAAAAACAGCGAGATCTTTAGCAGCATCAAAAAGCTTGAGAAACTGTTCAAAAACTTTGATGAGTATAGCAGCGC

AGGCATCTTTGTTAAAAATGGTCCGGCAATTAGCACCATCAGCAAAGATATTTTTGGCGAATGGAATGTGATCCGCG

ATAAATGGAATGCCGAATATGATGATATCCACCTGAAAAAAAAGGCCGTGGTGACCGAGAAATATGAAGATGATCGT

CGTAAAAGCTTCAAGAAAATTGGTAGCTTTAGCCTGGAACAGCTGCAAGAATATGCAGATGCAGATCTGAGCGTTGT

GGAAAAAACTGAAAGAAATCATCATTCAGAAGGTGGACGAGATCTATAAAGTTTATGGTAGCAGCGAAAAACTGTTCG

ATGCAGATTTTGTTCTGGAAAAAAGCCTGAAAAAGAATGATGCCGTTGTGGCCATTATGAAAGATCTGCTGGATAGC

GTTAAGAGCTTCGAGAATTACATCAAAGCCTTTTTTGGTGAGGGCAAAGAAACCAATCGTGATGAAAGTTTCTATGG

CGATTTTGTGCTGGCCTATGATATTCTGCTGAAAGTGGACCATATTTATGATGCCATTCGCAATTATGTTACCCAGA

AACCGTATAGCAAAGACAAGTTCAAACTGTACTTTCAGAACCCGCAGTTTATGGGTGGTTGGGATAAAGATAAAGAA

ACCGATTATCGTGCCACCATCCTGCGTTATGGTAGTAAATACTATCTGGCCATCATGGACAAAAAATACGCAAAATG

CCTGCAGAAAATCGACAAAGATGATGTGAATGGCAACTATGAAAAAATCAACTACAAACTGCTGCCTGGTCCGAATA

AAATGCTGCCGAAAGTGTTCTTTAGCAAGAAATGGATGGCCTATTATAACCCGAGCGAGGATATTCAAAAGATCTAC

AAAAATGGCACCTTTAAAAAGGGCGACATGTTCAATCTGAACGATTGCCACAAACTGATCGATTTCTTCAAAGATTC

-continued

```
AATTTCGCGTTATCCGAAATGGTCCAATGCCTATGATTTTAACTTTAGCGAAACCGAAAAATACAAAGACATTGCCG
GTTTTTATCGCGAAGTGGAAGAACAGGGCTATAAAGTGAGCTTTGAAAGCGCAAGCAAAAAAGAGGTTGATAAGCTG
GTTGAAGAGGGCAAACTGTATATGTTCCAGATTTACAACAAAGATTTTAGCGACAAAAGCCATGGCACCCCGAATCT
GCATACCATGTACTTTAAACTGCTGTTCGACGAAAATAACCATGGTCAGATTCGTCTGAGCGGTGGTGCCGAACTGT
TTATGCGTCGTGCAAGTCTGAAAAAAGAAGAACTGGTTGTTCATCCGGCAAATAGCCCGATTGCAAACAAAAATCCG
GACAATCCGAAAAAAACCACGACACTGAGCTATGATGTGTATAAAGACAAACGTTTTAGCGAGGATCAGTATCTGCT
GCATATCCCGATTGCCATCAATAAATGCCCGAAAAACATCTTTAAGATCAACACCGAAGTTCGCGTGCTGCTGAAAC
ATGATGATAATCCGTATGTGATTGGCATTGATCGTGGTAACGTAACCTGCTGTATATTGTTGTTGTTGATGGTAAA
GGCAACATCGTGGAACAGTATAGTCTGAACGAAATTATCAACAACTTTAACGGCATCCGCATCAAAACCGACTATCA
TAGCCTGCTGGACAAGAAAGAAAAAGAACGTTTTGAAGCACGTCAGAACTGGACCAGTATTGAAAACATCAAAGAAC
TGAAAGCCGGTTATATTAGCCAGGTGGTTCATAAAATCTGTGAGCTGGTAGAAAAATACGATGCAGTTATTGCACTG
GAAGATCTGAATAGCGGTTTCAAAAATAGCCGTGTGAAAGTCGAAAAACAGGTGTATCAGAAATTCGAGAAAATGCT
GATCGACAAACTGAACTACATGGTCGACAAAAAAAGCAATCCGTGTGCAACCGGTGGTGCACTGAAAGGTTATCAGA
TTACCAACAAATTTGAAAGCTTTAAAAGCATGAGCACCCAGAACGGCTTTATCTTCTATATTCCGGCATGGCTGACC
AGCAAAATTGATCCGAGCACCGGTTTTGTGAACCTGCTGAAAACAAAATATACCTCCATTGCCGACAGCAAGAAGTT
TATTAGCAGCTTTGATCGCATTATGTATGTTCCGGAAGAGGACCTGTTTGAATTCGCACTGGATTACAAAAATTTCA
GCCGTACCGATGCCGACTACATCAAAAAATGGAAACTGTACAGCTATGGTAACCGCATTCGCATTTTTCGCAACCCG
AAGAAAAACAATGTGTTCGATTGGGAAGAAGTTTGTCTGACCAGCGCATATAAAGAACTTTTCAACAAATACGGCAT
CAACTATCAGCAGGGTGATATTCGTGCACTGCTGTGTGAACAGAGCGATAAAGCGTTTTATAGCAGTTTTATGGCAC
TGATGAGCCTGATGCTGCAGATGCGTAATAGCATTACCGGTCGCACCGATGTGGATTTTCTGATTAGTCCGGTGAAA
AATTCCGATGGCATCTTTTATGATAGCCGCAATTACGAAGCACAAGAAATGCAATTCTGCCGAAAAACGCAGATGC
AAATGGTGCATATAACATTGCACGTAAAGTTCTGTGGGCAATTGGCCAGTTTAAGAAAGCAGAAGATGAGAAGCTGG
ACAAAGTGAAAATTGCGATCAGCAATAAAGAGTGGCTGGAATACGCACAGACCAGCGTTAAACATGCGCCAGCGCCT
GCTCCTGCACCCGCTCCAGCTCCTGCCCCAGCTCCAGCGCCCGCTCCTGCTCCTGCACCTGCGATGGTGAGCAAAGG
TGAAGAGGATAATATGGCCATCATCAAAGAATTCATGCGCTTCAAAGTTCATATGGAAGGTAGCGTTAATGGCCACG
AATTTGAAATTGAAGGTGAAGGCGAAGGTCGTCCGTATGAAGGCACCCAGACCGCAAAACTGAAAGTTACCAAAGGT
GGTCCGCTGCCGTTTGCATGGGATATTCTGAGTCCGCAGTTTATGTATGGTAGCAAAGCCTATGTTAAACATCCGGC
AGATATCCCGGATTATCTGAAACTGAGCTTTCCGGAAGGTTTTAAATGGGAACGTGTGATGAATTTTGAAGATGGTG
GTGTTGTTACCGTTACACAGGATAGCAGCCTGCAGGATGGTGAATTTATCTATAAAGTTAAACTGCGTGGCACGAAT
TTTCCGAGTGATGGTCCGGTTATGCAGAAAAAAACCATGGGTTGGGAAGCAAGCAGCGAACGTATGTATCCGGAAGA
TGGCGCACTGAAAGGTGAAATTAAACAGCGTCTGAAGCTGAAAGATGGCGGTCATTATGATGCAGAAGTTAAAACCA
CCTACAAAGCCAAAAAACCGGTTCAGCTGCCTGGTGCATATAACGTTAACATTAAACTGGATATCACCAGCCACAAC
GAGGATTATACCATTGTTGAACAGTATGAACGTGCAGAAGGTCGCCATAGTACCGGTGGTATGGATGAACTGTATAA
A
```

(LbCas12a (E795L)-APAPAPAPAPAPAPAPAPAPAPAPAPAPAPA-mCherry chimera DNA sequence)
SEQ ID NO: 428

```
ATGAGCAAACTGGAAAAGTTCACCAACTGTTATAGCCTGAGCAAAACCCTGCGTTTTAAAGCAATTCCGGTTGGTAA
AACCCAAGAGAACATTGATAATAAACGCCTGCTGGTCGAAGATGAAAAACGCGCTGAAGATTATAAAGGCGTGAAAA
AACTGCTGGATCGCTATTATCTGAGCTTCATTAACGATGTGCTGCACAGCATTAAACTGAAGAACCTGAACAACTAT
ATCAGCCTGTTTCGTAAAAAAACCCGCACCGAAAAAGAAAACAAAGAGCTGGAAAACCTGGAAATCAATCTGCGTAA
AGAAATCGCCAAAGCGTTTAAAGGTAACGAGGGTTATAAAAGCCTGTTCAAGAAAGACATCATCGAAACCATTCTGC
```

-continued

```
CGGAATTTCTGGATGATAAAGATGAAATTGCCCTGGTGAATAGCTTTAATGGCTTTACCACCGCATTTACCGGCTTT

TTTGATAATCGCGAAAACATGTTCAGCGAAGAAGCAAAAAGCACCAGCATTGCATTTCGCTGCATTAATGAAAATCT

GACCCGCTACATTAGCAACATGGATATCTTTGAAAAAGTGGACGCGATCTTCGATAAACACGAAGTGCAAGAGATCA

AAGAGAAAATCCTGAACAGCGATTATGACGTCGAAGATTTTTTTGAAGGCGAGTTCTTTAACTTCGTTCTGACCCAA

GAAGGTATCGACGTTTATAACGCAATTATTGGTGGTTTTGTTACCGAAAGCGGTGAGAAAATCAAAGGCCTGAATGA

ATATATCAACCTGTATAACCAGAAAACCAAACAGAAACTGCCGAAATTCAAACCGCTGTATAAACAGGTTCTGAGCG

ATCGTGAAAGCCTGAGCTTTTATGGTGAAGGTTATACCAGTGATGAAGAGGTTCTGGAAGTTTTTCGTAACACCCTG

AATAAAAACAGCGAGATCTTTAGCAGCATCAAAAAGCTTGAGAAACTGTTCAAAAACTTTGATGAGTATAGCAGCGC

AGGCATCTTTGTTAAAAATGGTCCGGCAATTAGCACCATCAGCAAAGATATTTTTGGCGAATGGAATGTGATCCGCG

ATAAATGGAATGCCGAATATGATGATATCCACCTGAAAAAAAAGGCCGTGGTGACCGAGAAATATGAAGATGATCGT

CGTAAAAGCTTCAAGAAAATTGGTAGCTTTAGCCTGGAACAGCTGCAAGAATATGCAGATGCAGATCTGAGCGTTGT

GGAAAAACTGAAAGAAATCATCATTCAGAAGGTGGACGAGATCTATAAAGTTTATGGTAGCAGCGAAAAACTGTTCG

ATGCAGATTTTGTTCTGGAAAAAGCCTGAAAAAGAATGATGCCGTTGTGGCCATTATGAAAGATCTGCTGGATAGC

GTTAAGAGCTTCGAGAATTACATCAAAGCCTTTTTTGGTGAGGGCAAAGAAACCAATCGTGATGAAAGTTTCTATGG

CGATTTTGTGCTGGCCTATGATATTCTGCTGAAAGTGGACCATATTTATGATGCCATTCGCAATTATGTTACCCAGA

AACCGTATAGCAAAGACAAGTTCAAACTGTACTTTCAGAACCCGCAGTTTATGGGTGGTTGGGATAAAGATAAAGAA

ACCGATTATCGTGCCACCATCCTGCGTTATGGTAGTAAATACTATCTGGCCATCATGGACAAAAAATACGCAAAATG

CCTGCAGAAAATCGACAAAGATGATGTGAATGGCAACTATGAAAAAATCAACTACAAACTGCTGCCTGGTCCGAATA

AAATGCTGCCGAAAGTGTTCTTTAGCAAGAAATGGATGGCCTATTATAACCCGAGCGAGGATATTCAAAAGATCTAC

AAAAATGGCACCTTTAAAAAGGGCGACATGTTCAATCTGAACGATTGCCACAAACTGATCGATTTCTTCAAAGATTC

AATTTCGCGTTATCCGAAATGGTCCAATGCCTATGATTTTAACTTTAGCGAAACCGAAAAATACAAAGACATTGCCG

GTTTTTATCGCGAAGTGGAAGAACAGGGCTATAAAGTGAGCTTTGAAAGCGCAAGCAAAAAAGAGGTTGATAAGCTG

GTTGAAGAGGGCAAACTGTATATGTTCCAGATTTACAACAAAGATTTTAGCGACAAAAGCCATGGCACCCCGAATCT

GCATACCATGTACTTTAAACTGCTGTTCGACGAAAATAACCATGGTCAGATTCGTCTGAGCGGTGGTGCCGAACTGT

TTATGCGTCGTGCAAGTCTGAAAAAAGAAGAACTGGTTGTTCATCCGGCAAATAGCCCGATTGCAAACAAAAATCCG

GACAATCCGAAAAAAACCACGACACTGAGCTATGATGTGTATAAAGACAAACGTTTTAGCGAGGATCAGTATCTGCT

GCATATCCCGATTGCCATCAATAAATGCCCGAAAAACATCTTTAAGATCAACACCGAAGTTCGCGTGCTGCTGAAAC

ATGATGATAATCCGTATGTGATTGGCATTGATCGTGGTGAACGTAACCTGCTGTATATTGTTGTTGATGGTAAA

GGCAACATCGTGGAACAGTATAGTCTGAACGAAATTATCAACAACTTTAACGGCATCCGCATCAAAACCGACTATCA

TAGCCTGCTGGACAAGAAGAAAAAGAACGTTTTGAAGCACGTCAGAACTGGACCAGTATTGAAAACATCAAAGAAC

TGAAAGCCGGTTATATTAGCCAGGTGGTTCATAAAATCTGTGAGCTGGTAGAAAAATACGATGCAGTTATTGCACTG

GAAGATCTGAATAGCGGTTTCAAAAATAGCCGTGTGAAAGTCGAAAAACAGGTGTATCAGAAATTCGAGAAAATGCT

GATCGACAAACTGAACTACATGGTCGACAAAAAAGCAATCCGTGTGCAACCGGTGGTGCACTGAAAGGTTATCAGA

TTACCAACAAATTTGAAAGCTTTAAAAGCATGAGCACCCAGAACGGCTTTATCTTCTATATTCCGGCATGGCTGACC

AGCAAAATTGATCCGAGCACCGGTTTTGTGAACCTGCTGAAAACAAAATATACCTCCATTGCCGACAGCAAGAAGTT

TATTAGCAGCTTTGATCGCATTATGTATGTTCCGGAAGAGGACCTGTTTGAATTCGCACTGGATTACAAAAATTTCA

GCCGTACCGATGCCGACTACATCAAAAAATGGAAACTGTACAGCTATGGTAACCGCATTCGCATTTTTCGCAACCCG

AAGAAAAACAATGTGTTCGATTGGGAAGAAGTTTGTCTGACCAGCGCATATAAAGAACTTTTCAACAATACGGCAT

CAACTATCAGCAGGGTGATATTCGTGCACTGCTGTGTGAACAGAGCGATAAAGCGTTTTATAGCAGTTTTATGGCAC

TGATGAGCCTGATGCTGCAGATGCGTAATAGCATTACCGGTCGCACCGATGTGGATTTTCTGATTAGTCCGGTGAAA

AATTCCGATGGCATCTTTTATGATAGCCGCAATTACGAAGCACAAGAAAATGCAATTCTGCCGAAAAACGCAGATGC
```

-continued

```
AAATGGTGCATATAACATTGCACGTAAAGTTCTGTGGGCAATTGGCCAGTTTAAGAAAGCAGAAGATGAGAAGCTGG
ACAAAGTGAAAATTGCGATCAGCAATAAAGAGTGGCTGGAATACGCACAGACCAGCGTTAAACATGCGCCAGCGCCT
GCTCCTGCACCCGCTCCAGCTCCTGCCCCAGCTCCAGCGCCCGCTCCTGCGCCAGCTCCTGCACCTGCGATGGTGAG
CAAAGGTGAAGAGGATAATATGGCCATCATCAAAGAATTCATGCGCTTCAAAGTTCATATGGAAGGTAGCGTTAATG
GCCACGAATTTGAAATTGAAGGTGAAGGCGAAGGTCGTCCGTATGAAGGCACCCAGACCGCAAAACTGAAAGTTACC
AAAGGTGGTCCGCTGCCGTTTGCATGGGATATTCTGAGTCCGCAGTTTATGTATGGTAGCAAAGCCTATGTTAAACA
TCCGGCAGATATCCCCGGATTATCTGAAACTGAGCTTTCCGGAAGGTTTTAAATGGGAACGTGTGATGAATTTTGAAG
ATGGTGGTGTTGTTACCGTTACACAGGATAGCAGCCTGCAGGATGGTGAATTTATCTATAAAGTTAAACTGCGTGGC
ACGAATTTTCCGAGTGATGGTCCGGTTATGCAGAAAAAAACCATGGGTTGGGAAGCAAGCAGCGAACGTATGTATCC
GGAAGATGGCGCACTGAAAGGTGAAATTAAACAGCGTCTGAAGCTGAAAGATGGCGGTCATTATGATGCAGAAGTTA
AAACCACCTACAAAGCCAAAAAACCGGTTCAGCTGCCTGGTGCATATAACGTTAACATTAAACTGGATATCACCAGC
CACAACGAGGATTATACCATTGTTGAACAGTATGAACGTGCAGAAGGTCGCCATAGTACCGGTGGTATGGATGAACT
GTATAAA
```

(LbCas12a (E795L)-APAPAPAPAPAPAPAPAPAPAPAPAPAPAPA-mCherry chimera DNA sequence)
SEQ ID NO: 429

```
ATGAGCAAACTGGAAAAGTTCACCAACTGTTATAGCCTGAGCAAAACCCTGCGTTTTAAAGCAATTCCGGTTGGTAA
AACCCAAGAGAACATTGATAATAAACGCCTGCTGGTCGAAGATGAAAAACGCGCTGAAGATTATAAAGGCGTGAAAA
AACTGCTGGATCGCTATTATCTGAGCTTCATTAACGATGTGCTGCACAGCATTAAACTGAAGAACCTGAACAACTAT
ATCAGCCTGTTTCGTAAAAAAACCCGCACCGAAAAGAAAACAAAGAGCTGGAAAACCTGGAAATCAATCTGCGTAA
AGAAATCGCCAAAGCGTTTAAAGGTAACGAGGGTTATAAAAGCCTGTTCAAGAAAGACATCATCGAAACCATTCTGC
CGGAATTTCTGGATGATAAAGATGAAATTGCCCTGGTGAATAGCTTTAATGGCTTTACCACCGCATTTACCGGCTTT
TTTGATAATCGCGAAAACATGTTCAGCGAAGAAGCAAAAAGCACCAGCATTGCATTTCGCTGCATTAATGAAAATCT
GACCCGCTACATTAGCAACATGGATATCTTTGAAAAAGTGGACGCGATCTTCGATAAACACGAAGTGCAAGAGATCA
AAGAGAAAATCCTGAACAGCGATTATGACGTCGAAGATTTTTTTGAAGGCGAGTTCTTTAACTTCGTTCTGACCCAA
GAAGGTATCGACGTTTATAACGCAATTATTGGTGGTTTTGTTACCGAAAGCGGTGAGAAAATCAAAGGCCTGAATGA
ATATATCAACCTGTATAACCAGAAAACCAAACAGAAACTGCCGAAATTCAAACCGCTGTATAAACAGGTTCTGAGCG
ATCGTGAAAGCCTGAGCTTTTATGGTGAAGGTTATACCAGTGATGAAGAGGTTCTGGAAGTTTTTCGTAACACCCTG
AATAAAAACAGCGAGATCTTTAGCAGCATCAAAAAGCTTGAGAAACTGTTCAAAAACTTTGATGAGTATAGCAGCGC
AGGCATCTTTGTTAAAAATGGTCCGGCAATTAGCACCATCAGCAAAGATATTTTTGGCGAATGGAATGTGATCCGCG
ATAAATGGAATGCCGAATATGATGATATCCACCTGAAAAAAAAGGCCGTGGTGACCGAGAAATATGAAGATGATCGT
CGTAAAAGCTTCAAGAAAATTGGTAGCTTTAGCCTGGAACAGCTGCAAGAATATGCAGATGCAGATCTGAGCGTTGT
GGAAAAACTGAAAGAAATCATCATTCAGAAGGTGGACGAGATCTATAAAGTTTATGGTAGCAGCGAAAAACTGTTCG
ATGCAGATTTTGTTCTGGAAAAAAGCCTGAAAAAGAATGATGCCGTTGTGGCCATTATGAAAGATCTGCTGGATAGC
GTTAAGAGCTTCGAGAATTACATCAAAGCCTTTTTTGGTGAGGGCAAAGAAACCAATCGTGATGAAAGTTTCTATGG
CGATTTTGTGCTGGCCTATGATATTCTGCTGAAAGTGGACCATATTTATGATGCCATTCGCAATTATGTTACCCAGA
AACCGTATAGCAAAGACAAGTTCAAACTGTACTTTCAGAACCCGCAGTTTATGGGTGGTTGGGATAAAGATAAAGAA
ACCGATTATCGTGCCACCATCCTGCGTTATGGTAGTAAATACTATCTGGCCATCATGGACAAAAAATACGCAAATG
CCTGCAGAAAATCGACAAAGATGATGTGAATGGCAACTATGAAAAAATCAACTACAAACTGCTGCCTGGTCCGAATA
AAATGCTGCCGAAAGTGTTCTTTAGCAAGAAATGGATGGCCTATTATAACCCGAGCGAGGATATTCAAAAGATCTAC
AAAAATGGCACCTTTAAAAAGGGCGACATGTTCAATCTGAACGATTGCCACAAACTGATCGATTTCTTCAAAGATTC
AATTTCGCGTTATCCGAAATGGTCCAATGCCTATGATTTTAACTTTAGCGAAACCGAAAAATACAAAGACATTGCCG
```

-continued

```
GTTTTTATCGCGAAGTGGAAGAACAGGGCTATAAAGTGAGCTTTGAAAGCGCAAGCAAAAAAGAGGTTGATAAGCTG

GTTGAAGAGGGCAAACTGTATATGTTCCAGATTTACAACAAAGATTTTAGCGACAAAAGCCATGGCACCCCGAATCT

GCATACCATGTACTTTAAACTGCTGTTCGACGAAAATAACCATGGTCAGATTCGTCTGAGCGGTGGTGCCGAACTGT

TTATGCGTCGTGCAAGTCTGAAAAAAGAAGAACTGGTTGTTCATCCGGCAAATAGCCCGATTGCAAACAAAAATCCG

GACAATCCGAAAAAAACCACGACACTGAGCTATGATGTGTATAAAGACAAACGTTTTAGCGAGGATCAGTATCTGCT

GCATATCCCGATTGCCATCAATAAATGCCCGAAAAACATCTTTAAGATCAACACCGAAGTTCGCGTGCTGCTGAAAC

ATGATGATAATCCGTATGTGATTGGCATTGATCGTGGTGAACGTAACCTGCTGTATATTGTTGTTGTTGATGGTAAA

GGCAACATCGTGGAACAGTATAGTCTGAACGAAATTATCAACAACTTTAACGGCATCCGCATCAAAACCGACTATCA

TAGCCTGCTGGACAAGAAAGAAAAAGAACGTTTTGAAGCACGTCAGAACTGGACCAGTATTGAAAACATCAAAGAAC

TGAAAGCCGGTTATATTAGCCAGGTGGTTCATAAAATCTGTGAGCTGGTAGAAAAATACGATGCAGTTATTGCACTG

GAAGATCTGAATAGCGGTTTCAAAAATAGCCGTGTGAAAGTCGAAAAACAGGTGTATCAGAAATTCGAGAAAATGCT

GATCGACAAACTGAACTACATGGTCGACAAAAAAAGCAATCCGTGTGCAACCGGTGGTGCACTGAAAGGTTATCAGA

TTACCAACAAATTTGAAAGCTTTAAAAGCATGAGCACCCAGAACGGCTTTATCTTCTATATTCCGGCATGGCTGACC

AGCAAAATTGATCCGAGCACCGGTTTTGTGAACCTGCTGAAAACAAAATATACCTCCATTGCCGACAGCAAGAAGTT

TATTAGCAGCTTTGATCGCATTATGTATGTTCCGGAAGAGGACCTGTTTGAATTCGCACTGGATTACAAAAATTTCA

GCCGTACCGATGCCGACTACATCAAAAAATGGAAACTGTACAGCTATGGTAACCGCATTCGCATTTTTCGCAACCCG

AAGAAAAACAATGTGTTCGATTGGGAAGAAGTTTGTCTGACCAGCGCATATAAAGAACTTTTCAACAAATACGGCAT

CAACTATCAGCAGGGTGATATTCGTGCACTGCTGTGTGAACAGAGCGATAAAGCGTTTTATAGCAGTTTTATGGCAC

TGATGAGCCTGATGCTGCAGATGCGTAATAGCATTACCGGTCGCACCGATGTGGATTTTCTGATTAGTCCGGTGAAA

AATTCCGATGGCATCTTTTATGATAGCCGCAATTACGAAGCACAAGAAAATGCAATTCTGCCGAAAAACGCAGATGC

AAATGGTGCATATAACATTGCACGTAAAGTTCTGTGGGCAATTGGCCAGTTTAAGAAAGCAGAAGATGAGAAGCTGG

ACAAAGTGAAAATTGCGATCAGCAATAAAGAGTGGCTGGAATACGCACAGACCAGCGTTAAACATGCGCCAGCGCCT

GCTCCTGCACCCGCTCCAGCTCCTGCCCCAGCTCCAGCGCCCGCTCCTGCGCCAGCTCCTGCACCTGCTCCAGCGAT

GGTGAGCAAAGGTGAAGAGGATAATATGGCCATCATCAAAGAATTCATGCGCTTCAAAGTTCATATGGAAGGTAGCG

TTAATGGCCACGAATTTGAAATTGAAGGTGAAGGCGAAGGTCGTCCGTATGAAGGCACCCAGACCGCAAAACTGAAA

GTTACCAAAGGTGGTCCGCTGCCGTTTGCATGGGATATTCTGAGTCCGCAGTTTATGTATGGTAGCAAAGCCTATGT

TAAACATCCGGCAGATATCCCGGATTATCTGAAACTGAGCTTTCCGGAAGGTTTTAAATGGGAACGTGTGATGAATT

TTGAAGATGGTGGTGTTGTTACCGTTACACAGGATAGCAGCCTGCAGGATGGTGAATTTATCTATAAAGTTAAACTG

CGTGGCACGAATTTTCCGAGTGATGGTCCGGTTATGCAGAAAAAAACCATGGGTTGGGAAGCAAGCAGCGAACGTAT

GTATCCGGAAGATGGCGCACTGAAAGGTGAAATTAAACAGCGTCTGAAGCTGAAAGATGGCGGTCATTATGATGCAG

AAGTTAAAACCACCTACAAAGCCAAAAAACCGGTTCAGCTGCCTGGTGCATATAACGTTAACATTAAACTGGATATC

ACCAGCCACAACGAGGATTATACCATTGTTGAACAGTATGAACGTGCAGAAGGTCGCCATAGTACCGGTGGTATGGA

TGAACTGTATAAA
```

All references, including publications, patent applications, and patents cited herein are hereby incorporated by reference to the same extent as if each reference were individually and specifically indicated to be incorporated by reference and were set forth in its entirety herein.

REFERENCES

1. Jinek, M., et al., *A programmable dual-RNA-guided DNA endonuclease in adaptive bacterial immunity*. Science, 2012. 337(6096): p. 816-21.
2. Rees, H. A. and D. R. Liu, *Base editing: precision chemistry on the genome and transcriptome of living cells*. Nat Rev Genet, 2018. 19(12): p. 770-788.
3. Komor, A. C., et al., *Programmable editing of a target base in genomic DNA without double-stranded DNA cleavage*. Nature, 2016. 533(7603): p. 420-4.
4. Gaudelli, N. M., et al., *Programmable base editing of A*T to G*C in genomic DNA without DNA cleavage*. Nature, 2017. 551(7681): p. 464-471.
5. Nishida, K., et al., *Targeted nucleotide editing using hybrid prokaryotic and vertebrate adaptive immune systems*. Science, 2016. 353(6305).

6. Qi, L. S., et al., *Repurposing CRISPR as an RNA guided platform for sequence specific control of gene expression.* Cell, 2013. 152(5): p. 1173-83.
7. Gilbert, L. A., et al., *CRISPR-mediated modular RNA-guided regulation of transcription in eukaryotes.* Cell, 2013. 154(2): p. 442-51.
8. Gilbert, L. A., et al., *Genome-Scale CRISPR-Mediated Control of Gene Repression and Activation.* Cell, 2014. 159(3): p. 647-61.
9. Anzalone, A. V., et al., *Search-and-replace genome editing without double-strand breaks or donor DNA.* Nature, 2019. 576(7785): p. 149-157.
10. Cong, L., et al., *Multiplex genome engineering using CRISPR/Cas systems.* Science, 2013. 339(6121): p. 819-23.
11. Vakulskas, C. A., et al., *A high-fidelity Cas9 mutant delivered as a ribonucleoprotein complex enables efficient gene editing in human hematopoietic stem and progenitor cells.* Nat Med, 2018. 24(8): p. 1216-1224.
12. Slaymaker, I. M., et al., *Rationally engineered Cas9 nucleases with improved specificity.* Science, 2016. 351(6268): p. 84-8.
13. Kleinstiver, B. P., et al., *High-fidelity CRISPR-Cas9 nucleases with no detectable genome-wide off-target effects.* Nature, 2016. 529(7587): p. 490-5.
14. Chen, J. S., et al., *Enhanced proofreading governs CRISPR-Cas9 targeting accuracy.* Nature, 2017. 550(7676): p. 407-410.
15. McCormick, A. L., M. S. Thomas, and A. W. Heath, *Immunization with an interferongamma-gp120 fusion protein induces enhanced immune responses to human immunodeficiency virus gp120.* J Infect Dis, 2001. 184(11): p. 1423-30.
16. Bai, Y. and W. C. Shen, *Improving the oral efficacy of recombinant granulocyte colony-stimulating factor and transferrin fusion protein by spacer optimization.* Pharm Res, 2006. 23(9): p. 2116-21.
17. Wriggers, W., S. Chakravarty, and P. A. Jennings, *Control of protein functional dynamics by peptide linkers.* Biopolymers, 2005. 80(6): p. 736-46.
18. Arai, R., et al., *Design of the linkers which effectively separate domains of a bifunctional fusion protein.* Protein Eng, 2001. 14(8): p. 529-32.
19. Marqusee, S. and R. L. Baldwin, *Helix stabilization by Glu-... Lys+ salt bridges in short peptides of de novo design.* Proc Natl Acad Sci USA, 1987. 84(24): p. 8898-902.
20. Bhandari, D. G., et al., *1H-NMR study of mobility and conformational constraints within the proline-rich N-terminal of the LCI alkali light chain of skeletal myosin. Correlation with similar segments in other protein systems.* Eur J Biochem, 1986. 160(2): p. 349-56.
21. Chen, X., J. L. Zaro, and W. C. Shen, *Fusion protein linkers: property, design and functionality.* Adv Drug Deliv Rev, 2013. 65(10): p. 1357-69.
22. Brendan P. Cormack, Raphael H. Valdivia, Stanley Falkow, *FACS-optimized mutants of the green fluorescent protein (GFP)*, Gene, 1996. 173 (1): 33-38.
23. Shaner N C, Campbell R E, Steinbach P A, Giepmans B N, Palmer A E, Tsien R Y. *Improved monomeric red, orange and yellow fluorescent proteins derived from Discosoma sp. red fluorescent protein.* Nat Biotechnol. 2004 December; 22(12):1567-72.
24. Peng, R., Li, Z., Xu, Y., He, S., Peng, Q., Wu, L. A., Wu, Y., Qi, J., Wang, P., Shi, Y. and Gao, G. F. *Structural insight into multistage inhibition of CRISPR-Cas12a by AcrVA4*, Proc. Natl. Acad. Sci. U.S.A. 2019 116(38): 18928-18936.

SEQUENCE LISTING (429 sequences)

SEQ ID NO: 1 - protein, 1368 aa, Artificial Sequence [sequence omitted]

SEQ ID NO: 2 - protein, 1307 aa, Artificial Sequence
  SYNTHETIC SEQUENCE
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 3 - protein, 1228 aa, Artificial Sequence
  SYNTHETIC SEQUENCE
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 4 - protein, 239 aa, Artificial Sequence
  SYNTHETIC SEQUENCE
MVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 5 - protein, 236 aa, Artificial Sequence
  SYNTHETIC SEQUENCE
MVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 6 - protein, 12 aa, Artificial Sequence
  SYNTHETIC
GSAGSAAGSGEF

SEQ ID NO: 7 - protein, 20 aa, Artificial Sequence
  SYNTHETIC
GGGGSGGGGSGGGGSGGGGS

SEQ ID NO: 8 - protein, 22 aa, Artificial Sequence
  SYNTHETIC
AEAAAKEAAAKEAAAKEAAAKA

SEQ ID NO: 9 - protein, 46 aa, Artificial Sequence
  SYNTHETIC
AEAAAKEAAAKEAAAKEAAAKALEAEAAAKEAAAKEAAAKEAAAKA

SEQ ID NO: 10 - protein, 50 aa, Artificial Sequence
  SYNTHETIC
LEAEAAAKEAAAKEAAAKEAAAKALEAEAAAKEAAAKEAAAKEAAAKALE

SEQ ID NO: 11 - protein, 5 aa, Artificial Sequence
  SYNTHETIC
APAPA

SEQ ID NO: 12 - protein, 7 aa, Artificial Sequence
  SYNTHETIC
APAPAPA

SEQ ID NO: 13 - protein, 9 aa, Artificial Sequence
  SYHTHETIC
APAPAPAPA

SEQ ID NO: 14 - protein, 11 aa, Artificial Sequence
  SYNTHETIC
APAPAPAPAPA

SEQ ID NO: 15 - protein, 13 aa, Artificial Sequence
  SYNTHETIC
APAPAPAPAPAPA

SEQ ID NO: 16 - protein, 15 aa, Artificial Sequence
  SYNTHETIC
APAPAPAPAPAPAPA

SEQ ID NO: 17 - protein, 17 aa, Artificial Sequence
  SYNTHETIC
APAPAPAPAPAPAPAPA

SEQ ID NO: 18 - protein, 19 aa, Artificial Sequence
  SYNTHETIC
APAPAPAPAPAPAPAPAPA

SEQ ID NO: 19 - protein, 21 aa, Artificial Sequence
  SYNTHETIC
APAPAPAPAPAPAPAPAPAPA

SEQ ID NO: 20 - protein, 23 aa, Artificial Sequence
  SYNTHETIC
APAPAPAPAPAPAPAPAPAPAPA

SEQ ID NO: 21 - protein, 25 aa, Artificial Sequence
  SYNTHETIC
APAPAPAPAPAPAPAPAPAPAPAPA

SEQ ID NO: 22 - protein, 27 aa, Artificial Sequence
  SYNTHETIC
APAPAPAPAPAPAPAPAPAPAPAPAPA

SEQ ID NO: 23 - protein, 29 aa, Artificial Sequence
  SYNTHETIC
APAPAPAPAPAPAPAPAPAPAPAPAPAPA

SEQ ID NO: 24 - protein, 4 aa, Artificial Sequence
  SYNTHETIC
  misc_feature (1)..(1): Xaa can be any naturally occurring amino acid
  misc_feature (3)..(3): Xaa can be any naturally occurring amino acid
XPXP

SEQ ID NO: 25 - protein, 6 aa, Artificial Sequence
  SYNTHETIC
  misc_feature (1)..(1): Xaa can be any naturally occurring amino acid
  misc_feature (3)..(3): Xaa can be any naturally occurring amino acid
  misc_feature (5)..(5): Xaa can be any naturally occurring amino acid
XPXPXP

SEQ ID NO: 26 - protein, 8 aa, Artificial Sequence
  SYNTHETIC
  misc_feature (1)..(1): Xaa can be any naturally occurring amino acid
  misc_feature (3)..(3): Xaa can be any naturally occurring amino acid
  misc_feature (5)..(5): Xaa can be any naturally occurring amino acid
  misc_feature (7)..(7): Xaa can be any naturally occurring amino acid
XPXPXPXP

SEQ ID NO: 27 - protein, 10 aa, Artificial Sequence
  SYNTHETIC
  misc_feature (1)..(1): Xaa can be any naturally occurring amino acid
  misc_feature (3)..(3): Xaa can be any naturally occurring amino acid
  misc_feature (5)..(5): Xaa can be any naturally occurring amino acid
  misc_feature (7)..(7): Xaa can be any naturally occurring amino acid
  misc_feature (9)..(9): Xaa can be any naturally occurring amino acid
XPXPXPXPXP

SEQ ID NO: 28 - protein, 12 aa, Artificial Sequence
  SYNTHETIC
  misc_feature (1)..(1): Xaa can be any naturally occurring amino acid
  misc_feature (3)..(3): Xaa can be any naturally occurring amino acid
  misc_feature (5)..(5): Xaa can be any naturally occurring amino acid
  misc_feature (7)..(7): Xaa can be any naturally occurring amino acid
  misc_feature (9)..(9): Xaa can be any naturally occurring amino acid
  misc_feature (11)..(11): Xaa can be any naturally occurring amino acid
XPXPXPXPXPXP

SEQ ID NO: 29 - protein, 14 aa, Artificial Sequence
  SYNTHETIC
  misc_feature (1)..(1): Xaa can be any naturally occurring amino acid
  misc_feature (3)..(3): Xaa can be any naturally occurring amino acid
  misc_feature (5)..(5): Xaa can be any naturally occurring amino acid
  misc_feature (7)..(7): Xaa can be any naturally occurring amino acid
  misc_feature (9)..(9): Xaa can be any naturally occurring amino acid
  misc_feature (11)..(11): Xaa can be any naturally occurring amino acid
  misc_feature (13)..(13): Xaa can be any naturally occurring amino acid
XPXPXPXPXPXPXP

SEQ ID NO: 30 - protein, 16 aa, Artificial Sequence
  SYNTHETIC
  misc_feature (1)..(1): Xaa can be any naturally occurring amino acid
  misc_feature (3)..(3): Xaa can be any naturally occurring amino acid
  misc_feature (5)..(5): Xaa can be any naturally occurring amino acid
  misc_feature (7)..(7): Xaa can be any naturally occurring amino acid
  misc_feature (9)..(9): Xaa can be any naturally occurring amino acid
  misc_feature (11)..(11): Xaa can be any naturally occurring amino acid
  misc_feature (13)..(13): Xaa can be any naturally occurring amino acid
  misc_feature (15)..(15): Xaa can be any naturally occurring amino acid
XPXPXPXPXPXPXPXP

SEQ ID NO: 31 - protein, 18 aa, Artificial Sequence
  SYNTHETIC
  misc_feature (1)..(1): Xaa can be any naturally occurring amino acid
  misc_feature (3)..(3): Xaa can be any naturally occurring amino acid
  misc_feature (5)..(5): Xaa can be any naturally occurring amino acid
  misc_feature (7)..(7): Xaa can be any naturally occurring amino acid
  misc_feature (9)..(9): Xaa can be any naturally occurring amino acid
  misc_feature (11)..(11): Xaa can be any naturally occurring amino acid
  misc_feature (13)..(13): Xaa can be any naturally occurring amino acid
  misc_feature (15)..(15): Xaa can be any naturally occurring amino acid
  misc_feature (17)..(17): Xaa can be any naturally occurring amino acid
XPXPXPXPXPXPXPXPXP

SEQ ID NO: 32 - protein, 20 aa, Artificial Sequence
  SYNTHETIC
  misc_feature (1)..(1): Xaa can be any naturally occurring amino acid
  misc_feature (3)..(3): Xaa can be any naturally occurring amino acid
  misc_feature (5)..(5): Xaa can be any naturally occurring amino acid
  misc_feature (7)..(7): Xaa can be any naturally occurring amino acid
  misc_feature (9)..(9): Xaa can be any naturally occurring amino acid
  misc_feature (11)..(11): Xaa can be any naturally occurring amino acid
  misc_feature (13)..(13): Xaa can be any naturally occurring amino acid
  misc_feature (15)..(15): Xaa can be any naturally occurring amino acid
  misc_feature (17)..(17): Xaa can be any naturally occurring amino acid
  misc_feature (19)..(19): Xaa can be any naturally occurring amino acid
XPXPXPXPXPXPXPXPXPXP

SEQ ID NO: 33 - protein, 22 aa, Artificial Sequence
  SYNTHETIC
  misc_feature (1)..(1): Xaa can be any naturally occurring amino acid
  misc_feature (3)..(3): Xaa can be any naturally occurring amino acid
  misc_feature (5)..(5): Xaa can be any naturally occurring amino acid
  misc_feature (7)..(7): Xaa can be any naturally occurring amino acid
  misc_feature (9)..(9): Xaa can be any naturally occurring amino acid
  misc_feature (11)..(11): Xaa can be any naturally occurring amino acid
  misc_feature (13)..(13): Xaa can be any naturally occurring amino acid
  misc_feature (15)..(15): Xaa can be any naturally occurring amino acid
  misc_feature (17)..(17): Xaa can be any naturally occurring amino acid
  misc_feature (19)..(19): Xaa can be any naturally occurring amino acid
  misc_feature (21)..(21): Xaa can be any naturally occurring amino acid
XPXPXPXPXPXPXPXPXPXPXP

SEQ ID NO: 34 - protein, 24 aa, Artificial Sequence
  SYNTHETIC
  misc_feature (1)..(1): Xaa can be any naturally occurring amino acid
  misc_feature (3)..(3): Xaa can be any naturally occurring amino acid
  misc_feature (5)..(5): Xaa can be any naturally occurring amino acid
  misc_feature (7)..(7): Xaa can be any naturally occurring amino acid
  misc_feature (9)..(9): Xaa can be any naturally occurring amino acid
  misc_feature (11)..(11): Xaa can be any naturally occurring amino acid
  misc_feature (13)..(13): Xaa can be any naturally occurring amino acid
  misc_feature (15)..(15): Xaa can be any naturally occurring amino acid
  misc_feature (17)..(17): Xaa can be any naturally occurring amino acid
  misc_feature (19)..(19): Xaa can be any naturally occurring amino acid
  misc_feature (21)..(21): Xaa can be any naturally occurring amino acid
  misc_feature (23)..(23): Xaa can be any naturally occurring amino acid
XPXPXPXPXPXPXPXPXPXPXPXP

SEQ ID NO: 35 - protein, 26 aa, Artificial Sequence
  SYNTHETIC
  misc_feature (1)..(1): Xaa can be any naturally occurring amino acid
  misc_feature (3)..(3): Xaa can be any naturally occurring amino acid
  misc_feature (5)..(5): Xaa can be any naturally occurring amino acid
  misc_feature (7)..(7): Xaa can be any naturally occurring amino acid
  misc_feature (9)..(9): Xaa can be any naturally occurring amino acid
  misc_feature (11)..(11): Xaa can be any naturally occurring amino acid
  misc_feature (13)..(13): Xaa can be any naturally occurring amino acid
  misc_feature (15)..(15): Xaa can be any naturally occurring amino acid
  misc_feature (17)..(17): Xaa can be any naturally occurring amino acid
  misc_feature (19)..(19): Xaa can be any naturally occurring amino acid
  misc_feature (21)..(21): Xaa can be any naturally occurring amino acid
  misc_feature (23)..(23): Xaa can be any naturally occurring amino acid
  misc_feature (25)..(25): Xaa can be any naturally occurring amino acid
XPXPXPXPXPXPXPXPXPXPXPXPXP

SEQ ID NO: 36 - protein, 28 aa, Artificial Sequence
  SYNTHETIC
  misc_feature (1)..(1): Xaa can be any naturally occurring amino acid
  misc_feature (3)..(3): Xaa can be any naturally occurring amino acid
  misc_feature (5)..(5): Xaa can be any naturally occurring amino acid
  misc_feature (7)..(7): Xaa can be any naturally occurring amino acid
  misc_feature (9)..(9): Xaa can be any naturally occurring amino acid
  misc_feature (11)..(11): Xaa can be any naturally occurring amino acid
  misc_feature (13)..(13): Xaa can be any naturally occurring amino acid
  misc_feature (15)..(15): Xaa can be any naturally occurring amino acid
  misc_feature (17)..(17): Xaa can be any naturally occurring amino acid
  misc_feature (19)..(19): Xaa can be any naturally occurring amino acid
  misc_feature (21)..(21): Xaa can be any naturally occurring amino acid
  misc_feature (23)..(23): Xaa can be any naturally occurring amino acid
  misc_feature (25)..(25): Xaa can be any naturally occurring amino acid
  misc_feature (27)..(27): Xaa can be any naturally occurring amino acid
XPXPXPXPXPXPXPXPXPXPXPXPXPXP

SEQ ID NO: 37 - protein, 15 aa, Artificial Sequence
  SYNTHETIC
GGGGSEAAAKGGGGS

SEQ ID NO: 38 - protein, 1619 aa, Artificial Sequence
  SYNTHETIC
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGSAGSAAGSGEFMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 39 - protein, 1627 aa, Artificial Sequence
  SYNTHETIC
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGGGSGGGGSGGGGSMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 40 - protein, 1629 aa, Artificial Sequence
  SYNTHETIC
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAEAAAKEAAAKEAAAKEAAAKAMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 41 - protein, 1653 aa, Artificial Sequence
  SYNTHETIC
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAEAAAKEAAAKEAAAKEAAAKALEAEAAAKEAAAKEAAAKEAAAKAMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 42 - protein, 1657 aa, Artificial Sequence
  SYNTHETIC
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDLEAEAAAKEAAAKEAAAKEAAAKALEAEAAAKEAAAKEAAAKEAAAKALEMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 43 - protein, 1610 aa, Artificial Sequence
  SYNTHETIC
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPAMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 44 - protein, 1612 aa, Artificial Sequence
  SYNTHETIC
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPAPAMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 45 - protein, 1614 aa, Artificial Sequence
  SYNTHETIC
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPAPAPAMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 46 - protein, 1616 aa, Artificial Sequence
  SYNTHETIC
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPAPAPAPAMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 47 - protein, 1618 aa, Artificial Sequence
  SYNTHETIC
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPAPAPAPAPAMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 48 - protein, 1620 aa, Artificial Sequence
  SYNTHETIC
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPAPAPAPAPAPAMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 49 - protein, 1622 aa, Artificial Sequence
  SYNTHETIC
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPAPAPAPAPAPAPAMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 50 - protein, 1624 aa, Artificial Sequence
  SYNTHETIC
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPAPAPAPAPAPAPAPAMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 51 - protein, 1626 aa, Artificial Sequence
  SYNTHETIC
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPAPAPAPAPAPAPAPAPAMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 52 - protein, 1628 aa, Artificial Sequence
  SYNTHETIC
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPAPAPAPAPAPAPAPAPAPAMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 53 - protein, 1630 aa, Artificial Sequence
  SYNTHETIC
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPAPAPAPAPAPAPAPAPAPAPAMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 54 - protein, 1632 aa, Artificial Sequence
  SYNTHETIC
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPAPAPAPAPAPAPAPAPAPAPAPAMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 55 - protein, 1634 aa, Artificial Sequence
  SYNTHETIC
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPAPAPAPAPAPAPAPAPAPAPAPAPAMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 56 - protein, 1636 aa, Artificial Sequence
  SYNTHETIC
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPAPAPAPAPAPAPAPAPAPAPAPAPAPAMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 57 - protein, 1609 aa, Artificial Sequence
  SYNTHETIC
  misc_feature (1369)..(1369): Xaa can be any naturally occurring amino acid
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDXPMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 58 - protein, 1611 aa, Artificial Sequence
  SYNTHETIC
  misc_feature (1369)..(1369): Xaa can be any naturally occurring amino acid
  misc_feature (1371)..(1371): Xaa can be any naturally occurring amino acid
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDXPXPMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 59 - protein, 1613 aa, Artificial Sequence
  SYNTHETIC
  misc_feature (1369)..(1369): Xaa can be any naturally occurring amino acid
  misc_feature (1371)..(1371): Xaa can be any naturally occurring amino acid
  misc_feature (1373)..(1373): Xaa can be any naturally occurring amino acid
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDXPXPXPMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 60 - protein, 1615 aa, Artificial Sequence
  SYNTHETIC
  misc_feature (1369)..(1369): Xaa can be any naturally occurring amino acid
  misc_feature (1371)..(1371): Xaa can be any naturally occurring amino acid
  misc_feature (1373)..(1373): Xaa can be any naturally occurring amino acid
  misc_feature (1375)..(1375): Xaa can be any naturally occurring amino acid
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDXPXPXPXPMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 61 - protein, 1617 aa, Artificial Sequence
  SYNTHETIC
  misc_feature (1369)..(1369): Xaa can be any naturally occurring amino acid
  misc_feature (1371)..(1371): Xaa can be any naturally occurring amino acid
  misc_feature (1373)..(1373): Xaa can be any naturally occurring amino acid
  misc_feature (1375)..(1375): Xaa can be any naturally occurring amino acid
  misc_feature (1377)..(1377): Xaa can be any naturally occurring amino acid
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDXPXPXPXPXPMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 62 - protein, 1619 aa, Artificial Sequence
  SYNTHETIC
  misc_feature (1369)..(1369): Xaa can be any naturally occurring amino acid
  misc_feature (1371)..(1371): Xaa can be any naturally occurring amino acid
  misc_feature (1373)..(1373): Xaa can be any naturally occurring amino acid
  misc_feature (1375)..(1375): Xaa can be any naturally occurring amino acid
  misc_feature (1377)..(1377): Xaa can be any naturally occurring amino acid
  misc_feature (1379)..(1379): Xaa can be any naturally occurring amino acid
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDXPXPXPXPXPXPMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 63 - protein, 1621 aa, Artificial Sequence
  SYNTHETIC
  misc_feature (1369)..(1369): Xaa can be any naturally occurring amino acid
  misc_feature (1371)..(1371): Xaa can be any naturally occurring amino acid
  misc_feature (1373)..(1373): Xaa can be any naturally occurring amino acid
  misc_feature (1375)..(1375): Xaa can be any naturally occurring amino acid
  misc_feature (1377)..(1377): Xaa can be any naturally occurring amino acid
  misc_feature (1379)..(1379): Xaa can be any naturally occurring amino acid
  misc_feature (1381)..(1381): Xaa can be any naturally occurring amino acid
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDXPXPXPXPXPXPXPMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 64 - protein, 1623 aa, Artificial Sequence
  SYNTHETIC
  misc_feature (1369)..(1369): Xaa can be any naturally occurring amino acid
  misc_feature (1371)..(1371): Xaa can be any naturally occurring amino acid
  misc_feature (1373)..(1373): Xaa can be any naturally occurring amino acid
  misc_feature (1375)..(1375): Xaa can be any naturally occurring amino acid
  misc_feature (1377)..(1377): Xaa can be any naturally occurring amino acid
  misc_feature (1379)..(1379): Xaa can be any naturally occurring amino acid
  misc_feature (1381)..(1381): Xaa can be any naturally occurring amino acid
  misc_feature (1383)..(1383): Xaa can be any naturally occurring amino acid
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDXPXPXPXPXPXPXPXPMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 65 - protein, 1625 aa, Artificial Sequence
  SYNTHETIC
  misc_feature (1369)..(1369): Xaa can be any naturally occurring amino acid
  misc_feature (1371)..(1371): Xaa can be any naturally occurring amino acid
  misc_feature (1373)..(1373): Xaa can be any naturally occurring amino acid
  misc_feature (1375)..(1375): Xaa can be any naturally occurring amino acid
  misc_feature (1377)..(1377): Xaa can be any naturally occurring amino acid
  misc_feature (1379)..(1379): Xaa can be any naturally occurring amino acid
  misc_feature (1381)..(1381): Xaa can be any naturally occurring amino acid
  misc_feature (1383)..(1383): Xaa can be any naturally occurring amino acid
  misc_feature (1385)..(1385): Xaa can be any naturally occurring amino acid
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDXPXPXPXPXPXPXPXPXPMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 66 - protein, 1627 aa, Artificial Sequence
  SYNTHETIC
  misc_feature (1369)..(1369): Xaa can be any naturally occurring amino acid
  misc_feature (1371)..(1371): Xaa can be any naturally occurring amino acid
  misc_feature (1373)..(1373): Xaa can be any naturally occurring amino acid
  misc_feature (1375)..(1375): Xaa can be any naturally occurring amino acid
  misc_feature (1377)..(1377): Xaa can be any naturally occurring amino acid
  misc_feature (1379)..(1379): Xaa can be any naturally occurring amino acid
  misc_feature (1381)..(1381): Xaa can be any naturally occurring amino acid
  misc_feature (1383)..(1383): Xaa can be any naturally occurring amino acid
  misc_feature (1385)..(1385): Xaa can be any naturally occurring amino acid
  misc_feature (1387)..(1387): Xaa can be any naturally occurring amino acid
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDXPXPXPXPXPXPXPXPXPXPMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 67 - protein, 1629 aa, Artificial Sequence
  SYNTHETIC
  misc_feature (1369)..(1369): Xaa can be any naturally occurring amino acid
  misc_feature (1371)..(1371): Xaa can be any naturally occurring amino acid
  misc_feature (1373)..(1373): Xaa can be any naturally occurring amino acid
  misc_feature (1375)..(1375): Xaa can be any naturally occurring amino acid
  misc_feature (1377)..(1377): Xaa can be any naturally occurring amino acid
  misc_feature (1379)..(1379): Xaa can be any naturally occurring amino acid
  misc_feature (1381)..(1381): Xaa can be any naturally occurring amino acid
  misc_feature (1383)..(1383): Xaa can be any naturally occurring amino acid
  misc_feature (1385)..(1385): Xaa can be any naturally occurring amino acid
  misc_feature (1387)..(1387): Xaa can be any naturally occurring amino acid
  misc_feature (1389)..(1389): Xaa can be any naturally occurring amino acid
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDXPXPXPXPXPXPXPXPXPXPXPMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 68 - protein, 1631 aa, Artificial Sequence
  SYNTHETIC
  misc_feature (1369)..(1369): Xaa can be any naturally occurring amino acid
  misc_feature (1371)..(1371): Xaa can be any naturally occurring amino acid
  misc_feature (1373)..(1373): Xaa can be any naturally occurring amino acid
  misc_feature (1375)..(1375): Xaa can be any naturally occurring amino acid
  misc_feature (1377)..(1377): Xaa can be any naturally occurring amino acid
  misc_feature (1379)..(1379): Xaa can be any naturally occurring amino acid
  misc_feature (1381)..(1381): Xaa can be any naturally occurring amino acid
  misc_feature (1383)..(1383): Xaa can be any naturally occurring amino acid
  misc_feature (1385)..(1385): Xaa can be any naturally occurring amino acid
  misc_feature (1387)..(1387): Xaa can be any naturally occurring amino acid
  misc_feature (1389)..(1389): Xaa can be any naturally occurring amino acid
  misc_feature (1391)..(1391): Xaa can be any naturally occurring amino acid
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDXPXPXPXPXPXPXPXPXPXPXPXPMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 69 - protein, 1633 aa, Artificial Sequence
  SYNTHETIC
  misc_feature (1369)..(1369): Xaa can be any naturally occurring amino acid
  misc_feature (1371)..(1371): Xaa can be any naturally occurring amino acid
  misc_feature (1373)..(1373): Xaa can be any naturally occurring amino acid
  misc_feature (1375)..(1375): Xaa can be any naturally occurring amino acid
  misc_feature (1377)..(1377): Xaa can be any naturally occurring amino acid
  misc_feature (1379)..(1379): Xaa can be any naturally occurring amino acid
  misc_feature (1381)..(1381): Xaa can be any naturally occurring amino acid
  misc_feature (1383)..(1383): Xaa can be any naturally occurring amino acid
  misc_feature (1385)..(1385): Xaa can be any naturally occurring amino acid
  misc_feature (1387)..(1387): Xaa can be any naturally occurring amino acid
  misc_feature (1389)..(1389): Xaa can be any naturally occurring amino acid
  misc_feature (1391)..(1391): Xaa can be any naturally occurring amino acid
  misc_feature (1393)..(1393): Xaa can be any naturally occurring amino acid
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDXPXPXPXPXPXPXPXPXPXPXPXPXPMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 70 - protein, 1635 aa, Artificial Sequence
  SYNTHETIC
  misc_feature (1369)..(1369): Xaa can be any naturally occurring amino acid
  misc_feature (1371)..(1371): Xaa can be any naturally occurring amino acid
  misc_feature (1373)..(1373): Xaa can be any naturally occurring amino acid
  misc_feature (1375)..(1375): Xaa can be any naturally occurring amino acid
  misc_feature (1377)..(1377): Xaa can be any naturally occurring amino acid
  misc_feature (1379)..(1379): Xaa can be any naturally occurring amino acid
  misc_feature (1381)..(1381): Xaa can be any naturally occurring amino acid
  misc_feature (1383)..(1383): Xaa can be any naturally occurring amino acid
  misc_feature (1385)..(1385): Xaa can be any naturally occurring amino acid
  misc_feature (1387)..(1387): Xaa can be any naturally occurring amino acid
  misc_feature (1389)..(1389): Xaa can be any naturally occurring amino acid
  misc_feature (1391)..(1391): Xaa can be any naturally occurring amino acid
  misc_feature (1393)..(1393): Xaa can be any naturally occurring amino acid
  misc_feature (1395)..(1395): Xaa can be any naturally occurring amino acid
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDXPXPXPXPXPXPXPXPXPXPXPXPXPXPMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 71 - protein, 1622 aa, Artificial Sequence
  SYNTHETIC
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSEAAAKGGGGSMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 72 - protein, 1616 aa, Artificial Sequence
  SYNTHETIC
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGSAGSAAGSGEFMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 73 - protein, 1624 aa, Artificial Sequence
  SYNTHETIC
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGGGSGGGGSGGGGSMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 74 - protein, 1626 aa, Artificial Sequence
  SYNTHETIC
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAEAAAKEAAAKEAAAKEAAAKAMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 75 - protein, 1650 aa, Artificial Sequence
  SYNTHETIC
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAEAAAKEAAAKEAAAKEAAAKALEAEAAAKEAAAKEAAAKEAAAKAMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 76 - protein, 1654 aa, Artificial Sequence
  SYNTHETIC
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDLEAEAAAKEAAAKEAAAKEAAAKALEAEAAAKEAAAKEAAAKEAAAKALEMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 77 - protein, 1607 aa, Artificial Sequence
  SYNTHETIC
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPAMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 78 - protein, 1609 aa, Artificial Sequence
  SYNTHETIC
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPAPAMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 79 - protein, 1611 aa, Artificial Sequence
  SYNTHETIC
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPAPAPAMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 80 - protein, 1613 aa, Artificial Sequence
  SYNTHETIC
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPAPAPAPAMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 81 - protein, 1615 aa, Artificial Sequence
  SYNTHETIC
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPAPAPAPAPAMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 82 - protein, 1617 aa, Artificial Sequence
  SYNTHETIC
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPAPAPAPAPAPAMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 83 - protein, 1619 aa, Artificial Sequence
  SYNTHETIC
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPAPAPAPAPAPAPAMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 84 - protein, 1621 aa, Artificial Sequence
  SYNTHETIC
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPAPAPAPAPAPAPAPAMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 85 - protein, 1623 aa, Artificial Sequence
  SYNTHETIC
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPAPAPAPAPAPAPAPAPAMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 86 - protein, 1625 aa, Artificial Sequence
  SYNTHETIC
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPAPAPAPAPAPAPAPAPAPAMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 87 - protein, 1627 aa, Artificial Sequence
  SYNTHETIC
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPAPAPAPAPAPAPAPAPAPAPAMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 88 - protein, 1629 aa, Artificial Sequence
  SYNTHETIC
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPAPAPAPAPAPAPAPAPAPAPAPAMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 89 - protein, 1631 aa, Artificial Sequence
  SYNTHETIC
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPAPAPAPAPAPAPAPAPAPAPAPAPAMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 90 - protein, 1633 aa, Artificial Sequence
  SYNTHETIC
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAPAPAPAPAPAPAPAPAPAPAPAPAPAPAMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 91 - protein, 1606 aa, Artificial Sequence
  SYNTHETIC
  misc_feature (1369)..(1369): Xaa can be any naturally occurring amino acid
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDXPMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 92 - protein, 1608 aa, Artificial Sequence
  SYNTHETIC
  misc_feature (1369)..(1369): Xaa can be any naturally occurring amino acid
  misc_feature (1371)..(1371): Xaa can be any naturally occurring amino acid
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDXPXPMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 93 - protein, 1610 aa, Artificial Sequence
  SYNTHETIC
  misc_feature (1369)..(1369): Xaa can be any naturally occurring amino acid
  misc_feature (1371)..(1371): Xaa can be any naturally occurring amino acid
  misc_feature (1373)..(1373): Xaa can be any naturally occurring amino acid
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDXPXPXPMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 94 - protein, 1612 aa, Artificial Sequence
  SYNTHETIC
  misc_feature (1369)..(1369): Xaa can be any naturally occurring amino acid
  misc_feature (1371)..(1371): Xaa can be any naturally occurring amino acid
  misc_feature (1373)..(1373): Xaa can be any naturally occurring amino acid
  misc_feature (1375)..(1375): Xaa can be any naturally occurring amino acid
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDXPXPXPXPMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 95 - protein, 1614 aa, Artificial Sequence
  SYNTHETIC
  misc_feature (1369)..(1369): Xaa can be any naturally occurring amino acid
  misc_feature (1371)..(1371): Xaa can be any naturally occurring amino acid
  misc_feature (1373)..(1373): Xaa can be any naturally occurring amino acid
  misc_feature (1375)..(1375): Xaa can be any naturally occurring amino acid
  misc_feature (1377)..(1377): Xaa can be any naturally occurring amino acid
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDXPXPXPXPXPMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 96 - protein, 1616 aa, Artificial Sequence
  SYNTHETIC
  misc_feature (1369)..(1369): Xaa can be any naturally occurring amino acid
  misc_feature (1371)..(1371): Xaa can be any naturally occurring amino acid
  misc_feature (1373)..(1373): Xaa can be any naturally occurring amino acid
  misc_feature (1375)..(1375): Xaa can be any naturally occurring amino acid
  misc_feature (1377)..(1377): Xaa can be any naturally occurring amino acid
  misc_feature (1379)..(1379): Xaa can be any naturally occurring amino acid
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDXPXPXPXPXPXPMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 97 - protein, 1618 aa, Artificial Sequence
  SYNTHETIC
  misc_feature (1369)..(1369): Xaa can be any naturally occurring amino acid
  misc_feature (1371)..(1371): Xaa can be any naturally occurring amino acid
  misc_feature (1373)..(1373): Xaa can be any naturally occurring amino acid
  misc_feature (1375)..(1375): Xaa can be any naturally occurring amino acid
  misc_feature (1377)..(1377): Xaa can be any naturally occurring amino acid
  misc_feature (1379)..(1379): Xaa can be any naturally occurring amino acid
  misc_feature (1381)..(1381): Xaa can be any naturally occurring amino acid
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDXPXPXPXPXPXPXPMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 98 - protein, 1620 aa, Artificial Sequence
  SYNTHETIC
  misc_feature (1369)..(1369): Xaa can be any naturally occurring amino acid
  misc_feature (1371)..(1371): Xaa can be any naturally occurring amino acid
  misc_feature (1373)..(1373): Xaa can be any naturally occurring amino acid
  misc_feature (1375)..(1375): Xaa can be any naturally occurring amino acid
  misc_feature (1377)..(1377): Xaa can be any naturally occurring amino acid
  misc_feature (1379)..(1379): Xaa can be any naturally occurring amino acid
  misc_feature (1381)..(1381): Xaa can be any naturally occurring amino acid
  misc_feature (1383)..(1383): Xaa can be any naturally occurring amino acid
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDXPXPXPXPXPXPXPXPMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 99 - protein, 1622 aa, Artificial Sequence
  SYNTHETIC
  misc_feature (1369)..(1369): Xaa can be any naturally occurring amino acid
  misc_feature (1371)..(1371): Xaa can be any naturally occurring amino acid
  misc_feature (1373)..(1373): Xaa can be any naturally occurring amino acid
  misc_feature (1375)..(1375): Xaa can be any naturally occurring amino acid
  misc_feature (1377)..(1377): Xaa can be any naturally occurring amino acid
  misc_feature (1379)..(1379): Xaa can be any naturally occurring amino acid
  misc_feature (1381)..(1381): Xaa can be any naturally occurring amino acid
  misc_feature (1383)..(1383): Xaa can be any naturally occurring amino acid
  misc_feature (1385)..(1385): Xaa can be any naturally occurring amino acid
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDXPXPXPXPXPXPXPXPXPMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 100 - protein, 1624 aa, Artificial Sequence
  SYNTHETIC
  misc_feature (1369)..(1369): Xaa can be any naturally occurring amino acid
  misc_feature (1371)..(1371): Xaa can be any naturally occurring amino acid
  misc_feature (1373)..(1373): Xaa can be any naturally occurring amino acid
  misc_feature (1375)..(1375): Xaa can be any naturally occurring amino acid
  misc_feature (1377)..(1377): Xaa can be any naturally occurring amino acid
  misc_feature (1379)..(1379): Xaa can be any naturally occurring amino acid
  misc_feature (1381)..(1381): Xaa can be any naturally occurring amino acid
  misc_feature (1383)..(1383): Xaa can be any naturally occurring amino acid
  misc_feature (1385)..(1385): Xaa can be any naturally occurring amino acid
  misc_feature (1387)..(1387): Xaa can be any naturally occurring amino acid
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDXPXPXPXPXPXPXPXPXPXPMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 101 - protein, 1626 aa, Artificial Sequence
  SYNTHETIC
  misc_feature (1369)..(1369): Xaa can be any naturally occurring amino acid
  misc_feature (1371)..(1371): Xaa can be any naturally occurring amino acid
  misc_feature (1373)..(1373): Xaa can be any naturally occurring amino acid
  misc_feature (1375)..(1375): Xaa can be any naturally occurring amino acid
  misc_feature (1377)..(1377): Xaa can be any naturally occurring amino acid
  misc_feature (1379)..(1379): Xaa can be any naturally occurring amino acid
  misc_feature (1381)..(1381): Xaa can be any naturally occurring amino acid
  misc_feature (1383)..(1383): Xaa can be any naturally occurring amino acid
  misc_feature (1385)..(1385): Xaa can be any naturally occurring amino acid
  misc_feature (1387)..(1387): Xaa can be any naturally occurring amino acid
  misc_feature (1389)..(1389): Xaa can be any naturally occurring amino acid
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDXPXPXPXPXPXPXPXPXPXPXPMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 102 - protein, 1628 aa, Artificial Sequence
  SYNTHETIC
  misc_feature (1369)..(1369): Xaa can be any naturally occurring amino acid
  misc_feature (1371)..(1371): Xaa can be any naturally occurring amino acid
  misc_feature (1373)..(1373): Xaa can be any naturally occurring amino acid
  misc_feature (1375)..(1375): Xaa can be any naturally occurring amino acid
  misc_feature (1377)..(1377): Xaa can be any naturally occurring amino acid
  misc_feature (1379)..(1379): Xaa can be any naturally occurring amino acid
  misc_feature (1381)..(1381): Xaa can be any naturally occurring amino acid
  misc_feature (1383)..(1383): Xaa can be any naturally occurring amino acid
  misc_feature (1385)..(1385): Xaa can be any naturally occurring amino acid
  misc_feature (1387)..(1387): Xaa can be any naturally occurring amino acid
  misc_feature (1389)..(1389): Xaa can be any naturally occurring amino acid
  misc_feature (1391)..(1391): Xaa can be any naturally occurring amino acid
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDXPXPXPXPXPXPXPXPXPXPXPXPMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 103 - protein, 1630 aa, Artificial Sequence
  SYNTHETIC
  misc_feature (1369)..(1369): Xaa can be any naturally occurring amino acid
  misc_feature (1371)..(1371): Xaa can be any naturally occurring amino acid
  misc_feature (1373)..(1373): Xaa can be any naturally occurring amino acid
  misc_feature (1375)..(1375): Xaa can be any naturally occurring amino acid
  misc_feature (1377)..(1377): Xaa can be any naturally occurring amino acid
  misc_feature (1379)..(1379): Xaa can be any naturally occurring amino acid
  misc_feature (1381)..(1381): Xaa can be any naturally occurring amino acid
  misc_feature (1383)..(1383): Xaa can be any naturally occurring amino acid
  misc_feature (1385)..(1385): Xaa can be any naturally occurring amino acid
  misc_feature (1387)..(1387): Xaa can be any naturally occurring amino acid
  misc_feature (1389)..(1389): Xaa can be any naturally occurring amino acid
  misc_feature (1391)..(1391): Xaa can be any naturally occurring amino acid
  misc_feature (1393)..(1393): Xaa can be any naturally occurring amino acid
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDXPXPXPXPXPXPXPXPXPXPXPXPXPMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 104 - protein, 1632 aa, Artificial Sequence
  SYNTHETIC
  misc_feature (1369)..(1369): Xaa can be any naturally occurring amino acid
  misc_feature (1371)..(1371): Xaa can be any naturally occurring amino acid
  misc_feature (1373)..(1373): Xaa can be any naturally occurring amino acid
  misc_feature (1375)..(1375): Xaa can be any naturally occurring amino acid
  misc_feature (1377)..(1377): Xaa can be any naturally occurring amino acid
  misc_feature (1379)..(1379): Xaa can be any naturally occurring amino acid
  misc_feature (1381)..(1381): Xaa can be any naturally occurring amino acid
  misc_feature (1383)..(1383): Xaa can be any naturally occurring amino acid
  misc_feature (1385)..(1385): Xaa can be any naturally occurring amino acid
  misc_feature (1387)..(1387): Xaa can be any naturally occurring amino acid
  misc_feature (1389)..(1389): Xaa can be any naturally occurring amino acid
  misc_feature (1391)..(1391): Xaa can be any naturally occurring amino acid
  misc_feature (1393)..(1393): Xaa can be any naturally occurring amino acid
  misc_feature (1395)..(1395): Xaa can be any naturally occurring amino acid
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDXPXPXPXPXPXPXPXPXPXPXPXPXPXPMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 105 - protein, 1619 aa, Artificial Sequence
  SYNTHETIC
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSEAAAKGGGGSMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 106 - protein, 1558 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNGSAGSAAGSGEFMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 107 - protein, 1566 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNGGGGSGGGGSGGGGSGGGGSMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 108 - protein, 1568 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNAEAAAKEAAAKEAAAKEAAAKAMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 109 - protein, 1592 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNAEAAAKEAAAKEAAAKEAAAKALEAEAAAKEAAAKEAAAKEAAAKAMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 110 - protein, 1596 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNLEAEAAAKEAAAKEAAAKEAAAKALEAEAAAKEAAAKEAAAKEAAAKALEMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 111 - protein, 1549 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNAPAMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 112 - protein, 1551 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNAPAPAMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 113 - protein, 1553 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNAPAPAPAMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 114 - protein, 1555 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNAPAPAPAPAMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 115 - protein, 1557 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNAPAPAPAPAPAMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 116 - protein, 1559 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNAPAPAPAPAPAPAMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 117 - protein, 1561 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNAPAPAPAPAPAPAPAMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 118 - protein, 1563 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNAPAPAPAPAPAPAPAPAMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 119 - protein, 1565 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNAPAPAPAPAPAPAPAPAPAMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 120 - protein, 1567 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNAPAPAPAPAPAPAPAPAPAPAMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 121 - protein, 1569 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNAPAPAPAPAPAPAPAPAPAPAPAMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 122 - protein, 1571 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNAPAPAPAPAPAPAPAPAPAPAPAPAMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 123 - protein, 1573 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNAPAPAPAPAPAPAPAPAPAPAPAPAPAMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 124 - protein, 1575 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNAPAPAPAPAPAPAPAPAPAPAPAPAPAPAMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 125 - protein, 1548 aa, Artificial Sequence
  SYNTHETIC
  misc_feature (1308)..(1308): Xaa can be any naturally occurring amino acid
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNXPMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 126 - protein, 1550 aa, Artificial Sequence
  SYNTHETIC
  misc_feature (1308)..(1308): Xaa can be any naturally occurring amino acid
  misc_feature (1310)..(1310): Xaa can be any naturally occurring amino acid
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNXPXPMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 127 - protein, 1552 aa, Artificial Sequence
  SYNTHETIC
  misc_feature (1308)..(1308): Xaa can be any naturally occurring amino acid
  misc_feature (1310)..(1310): Xaa can be any naturally occurring amino acid
  misc_feature (1312)..(1312): Xaa can be any naturally occurring amino acid
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNXPXPXPMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 128 - protein, 1554 aa, Artificial Sequence
  SYNTHETIC
  misc_feature (1308)..(1308): Xaa can be any naturally occurring amino acid
  misc_feature (1310)..(1310): Xaa can be any naturally occurring amino acid
  misc_feature (1312)..(1312): Xaa can be any naturally occurring amino acid
  misc_feature (1314)..(1314): Xaa can be any naturally occurring amino acid
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNXPXPXPXPMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 129 - protein, 1556 aa, Artificial Sequence
  SYNTHETIC
  misc_feature (1308)..(1308): Xaa can be any naturally occurring amino acid
  misc_feature (1310)..(1310): Xaa can be any naturally occurring amino acid
  misc_feature (1312)..(1312): Xaa can be any naturally occurring amino acid
  misc_feature (1314)..(1314): Xaa can be any naturally occurring amino acid
  misc_feature (1316)..(1316): Xaa can be any naturally occurring amino acid
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNXPXPXPXPXPMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 130 - protein, 1558 aa, Artificial Sequence
  SYNTHETIC
  misc_feature (1308)..(1308): Xaa can be any naturally occurring amino acid
  misc_feature (1310)..(1310): Xaa can be any naturally occurring amino acid
  misc_feature (1312)..(1312): Xaa can be any naturally occurring amino acid
  misc_feature (1314)..(1314): Xaa can be any naturally occurring amino acid
  misc_feature (1316)..(1316): Xaa can be any naturally occurring amino acid
  misc_feature (1318)..(1318): Xaa can be any naturally occurring amino acid
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNXPXPXPXPXPXPMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 131 - protein, 1560 aa, Artificial Sequence
  SYNTHETIC
  misc_feature (1308)..(1308): Xaa can be any naturally occurring amino acid
  misc_feature (1310)..(1310): Xaa can be any naturally occurring amino acid
  misc_feature (1312)..(1312): Xaa can be any naturally occurring amino acid
  misc_feature (1314)..(1314): Xaa can be any naturally occurring amino acid
  misc_feature (1316)..(1316): Xaa can be any naturally occurring amino acid
  misc_feature (1318)..(1318): Xaa can be any naturally occurring amino acid
  misc_feature (1320)..(1320): Xaa can be any naturally occurring amino acid
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNXPXPXPXPXPXPXPMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 132 - protein, 1562 aa, Artificial Sequence
  SYNTHETIC
  misc_feature (1308)..(1308): Xaa can be any naturally occurring amino acid
  misc_feature (1310)..(1310): Xaa can be any naturally occurring amino acid
  misc_feature (1312)..(1312): Xaa can be any naturally occurring amino acid
  misc_feature (1314)..(1314): Xaa can be any naturally occurring amino acid
  misc_feature (1316)..(1316): Xaa can be any naturally occurring amino acid
  misc_feature (1318)..(1318): Xaa can be any naturally occurring amino acid
  misc_feature (1320)..(1320): Xaa can be any naturally occurring amino acid
  misc_feature (1322)..(1322): Xaa can be any naturally occurring amino acid
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNXPXPXPXPXPXPXPXPMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 133 - protein, 1564 aa, Artificial Sequence
  SYNTHETIC
  misc_feature (1308)..(1308): Xaa can be any naturally occurring amino acid
  misc_feature (1310)..(1310): Xaa can be any naturally occurring amino acid
  misc_feature (1312)..(1312): Xaa can be any naturally occurring amino acid
  misc_feature (1314)..(1314): Xaa can be any naturally occurring amino acid
  misc_feature (1316)..(1316): Xaa can be any naturally occurring amino acid
  misc_feature (1318)..(1318): Xaa can be any naturally occurring amino acid
  misc_feature (1320)..(1320): Xaa can be any naturally occurring amino acid
  misc_feature (1322)..(1322): Xaa can be any naturally occurring amino acid
  misc_feature (1324)..(1324): Xaa can be any naturally occurring amino acid
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNXPXPXPXPXPXPXPXPXPMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 134 - protein, 1566 aa, Artificial Sequence
  SYNTHETIC
  misc_feature (1308)..(1308): Xaa can be any naturally occurring amino acid
  misc_feature (1310)..(1310): Xaa can be any naturally occurring amino acid
  misc_feature (1312)..(1312): Xaa can be any naturally occurring amino acid
  misc_feature (1314)..(1314): Xaa can be any naturally occurring amino acid
  misc_feature (1316)..(1316): Xaa can be any naturally occurring amino acid
  misc_feature (1318)..(1318): Xaa can be any naturally occurring amino acid
  misc_feature (1320)..(1320): Xaa can be any naturally occurring amino acid
  misc_feature (1322)..(1322): Xaa can be any naturally occurring amino acid
  misc_feature (1324)..(1324): Xaa can be any naturally occurring amino acid
  misc_feature (1326)..(1326): Xaa can be any naturally occurring amino acid
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNXPXPXPXPXPXPXPXPXPXPMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 135 - protein, 1568 aa, Artificial Sequence
  SYNTHETIC
  misc_feature (1308)..(1308): Xaa can be any naturally occurring amino acid
  misc_feature (1310)..(1310): Xaa can be any naturally occurring amino acid
  misc_feature (1312)..(1312): Xaa can be any naturally occurring amino acid
  misc_feature (1314)..(1314): Xaa can be any naturally occurring amino acid
  misc_feature (1316)..(1316): Xaa can be any naturally occurring amino acid
  misc_feature (1318)..(1318): Xaa can be any naturally occurring amino acid
  misc_feature (1320)..(1320): Xaa can be any naturally occurring amino acid
  misc_feature (1322)..(1322): Xaa can be any naturally occurring amino acid
  misc_feature (1324)..(1324): Xaa can be any naturally occurring amino acid
  misc_feature (1326)..(1326): Xaa can be any naturally occurring amino acid
  misc_feature (1328)..(1328): Xaa can be any naturally occurring amino acid
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNXPXPXPXPXPXPXPXPXPXPXPMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 136 - protein, 1570 aa, Artificial Sequence
  SYNTHETIC
  misc_feature (1308)..(1308): Xaa can be any naturally occurring amino acid
  misc_feature (1310)..(1310): Xaa can be any naturally occurring amino acid
  misc_feature (1312)..(1312): Xaa can be any naturally occurring amino acid
  misc_feature (1314)..(1314): Xaa can be any naturally occurring amino acid
  misc_feature (1316)..(1316): Xaa can be any naturally occurring amino acid
  misc_feature (1318)..(1318): Xaa can be any naturally occurring amino acid
  misc_feature (1320)..(1320): Xaa can be any naturally occurring amino acid
  misc_feature (1322)..(1322): Xaa can be any naturally occurring amino acid
  misc_feature (1324)..(1324): Xaa can be any naturally occurring amino acid
  misc_feature (1326)..(1326): Xaa can be any naturally occurring amino acid
  misc_feature (1328)..(1328): Xaa can be any naturally occurring amino acid
  misc_feature (1330)..(1330): Xaa can be any naturally occurring amino acid
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNXPXPXPXPXPXPXPXPXPXPXPXPMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 137 - protein, 1572 aa, Artificial Sequence
  SYNTHETIC
  misc_feature (1308)..(1308): Xaa can be any naturally occurring amino acid
  misc_feature (1310)..(1310): Xaa can be any naturally occurring amino acid
  misc_feature (1312)..(1312): Xaa can be any naturally occurring amino acid
  misc_feature (1314)..(1314): Xaa can be any naturally occurring amino acid
  misc_feature (1316)..(1316): Xaa can be any naturally occurring amino acid
  misc_feature (1318)..(1318): Xaa can be any naturally occurring amino acid
  misc_feature (1320)..(1320): Xaa can be any naturally occurring amino acid
  misc_feature (1322)..(1322): Xaa can be any naturally occurring amino acid
  misc_feature (1324)..(1324): Xaa can be any naturally occurring amino acid
  misc_feature (1326)..(1326): Xaa can be any naturally occurring amino acid
  misc_feature (1328)..(1328): Xaa can be any naturally occurring amino acid
  misc_feature (1330)..(1330): Xaa can be any naturally occurring amino acid
  misc_feature (1332)..(1332): Xaa can be any naturally occurring amino acid
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNXPXPXPXPXPXPXPXPXPXPXPXPXPMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 138 - protein, 1574 aa, Artificial Sequence
  SYNTHETIC
  misc_feature (1308)..(1308): Xaa can be any naturally occurring amino acid
  misc_feature (1310)..(1310): Xaa can be any naturally occurring amino acid
  misc_feature (1312)..(1312): Xaa can be any naturally occurring amino acid
  misc_feature (1314)..(1314): Xaa can be any naturally occurring amino acid
  misc_feature (1316)..(1316): Xaa can be any naturally occurring amino acid
  misc_feature (1318)..(1318): Xaa can be any naturally occurring amino acid
  misc_feature (1320)..(1320): Xaa can be any naturally occurring amino acid
  misc_feature (1322)..(1322): Xaa can be any naturally occurring amino acid
  misc_feature (1324)..(1324): Xaa can be any naturally occurring amino acid
  misc_feature (1326)..(1326): Xaa can be any naturally occurring amino acid
  misc_feature (1328)..(1328): Xaa can be any naturally occurring amino acid
  misc_feature (1330)..(1330): Xaa can be any naturally occurring amino acid
  misc_feature (1332)..(1332): Xaa can be any naturally occurring amino acid
  misc_feature (1334)..(1334): Xaa can be any naturally occurring amino acid
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNXPXPXPXPXPXPXPXPXPXPXPXPXPXPMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 139 - protein, 1561 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNGGGGSEAAAKGGGGSMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 140 - protein, 1555 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNGSAGSAAGSGEFMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 141 - protein, 1563 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNGGGGSGGGGSGGGGSGGGGSMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 142 - protein, 1565 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNAEAAAKEAAAKEAAAKEAAAKAMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 143 - protein, 1589 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNAEAAAKEAAAKEAAAKEAAAKALEAEAAAKEAAAKEAAAKEAAAKAMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 144 - protein, 1593 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNLEAEAAAKEAAAKEAAAKEAAAKALEAEAAAKEAAAKEAAAKEAAAKALEMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 145 - protein, 1546 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNAPAMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 146 - protein, 1548 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNAPAPAMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 147 - protein, 1550 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNAPAPAPAMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 148 - protein, 1552 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNAPAPAPAPAMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 149 - protein, 1554 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNAPAPAPAPAPAMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 150 - protein, 1556 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNAPAPAPAPAPAPAMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 151 - protein, 1558 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNAPAPAPAPAPAPAPAMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 152 - protein, 1560 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNAPAPAPAPAPAPAPAPAMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 153 - protein, 1562 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNAPAPAPAPAPAPAPAPAPAMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 154 - protein, 1564 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNAPAPAPAPAPAPAPAPAPAPAMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 155 - protein, 1566 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNAPAPAPAPAPAPAPAPAPAPAPAMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 156 - protein, 1568 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNAPAPAPAPAPAPAPAPAPAPAPAPAMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 157 - protein, 1570 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNAPAPAPAPAPAPAPAPAPAPAPAPAPAMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 158 - protein, 1572 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNAPAPAPAPAPAPAPAPAPAPAPAPAPAPAMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 159 - protein, 1545 aa, Artificial Sequence
  SYNTHETIC
  misc_feature (1308)..(1308): Xaa can be any naturally occurring amino acid
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNXPMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 160 - protein, 1547 aa, Artificial Sequence
  SYNTHETIC
  misc_feature (1308)..(1308): Xaa can be any naturally occurring amino acid
  misc_feature (1310)..(1310): Xaa can be any naturally occurring amino acid
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNXPXPMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 161 - protein, 1549 aa, Artificial Sequence
  SYNTHETIC
  misc_feature (1308)..(1308): Xaa can be any naturally occurring amino acid
  misc_feature (1310)..(1310): Xaa can be any naturally occurring amino acid
  misc_feature (1312)..(1312): Xaa can be any naturally occurring amino acid
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNXPXPXPMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 162 - protein, 1551 aa, Artificial Sequence
  SYNTHETIC
  misc_feature (1308)..(1308): Xaa can be any naturally occurring amino acid
  misc_feature (1310)..(1310): Xaa can be any naturally occurring amino acid
  misc_feature (1312)..(1312): Xaa can be any naturally occurring amino acid
  misc_feature (1314)..(1314): Xaa can be any naturally occurring amino acid
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNXPXPXPXPMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 163 - protein, 1553 aa, Artificial Sequence
  SYNTHETIC
  misc_feature (1308)..(1308): Xaa can be any naturally occurring amino acid
  misc_feature (1310)..(1310): Xaa can be any naturally occurring amino acid
  misc_feature (1312)..(1312): Xaa can be any naturally occurring amino acid
  misc_feature (1314)..(1314): Xaa can be any naturally occurring amino acid
  misc_feature (1316)..(1316): Xaa can be any naturally occurring amino acid
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNXPXPXPXPXPMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 164 - protein, 1555 aa, Artificial Sequence
  SYNTHETIC
  misc_feature (1308)..(1308): Xaa can be any naturally occurring amino acid
  misc_feature (1310)..(1310): Xaa can be any naturally occurring amino acid
  misc_feature (1312)..(1312): Xaa can be any naturally occurring amino acid
  misc_feature (1314)..(1314): Xaa can be any naturally occurring amino acid
  misc_feature (1316)..(1316): Xaa can be any naturally occurring amino acid
  misc_feature (1318)..(1318): Xaa can be any naturally occurring amino acid
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNXPXPXPXPXPXPMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 165 - protein, 1557 aa, Artificial Sequence
  SYNTHETIC
  misc_feature (1308)..(1308): Xaa can be any naturally occurring amino acid
  misc_feature (1310)..(1310): Xaa can be any naturally occurring amino acid
  misc_feature (1312)..(1312): Xaa can be any naturally occurring amino acid
  misc_feature (1314)..(1314): Xaa can be any naturally occurring amino acid
  misc_feature (1316)..(1316): Xaa can be any naturally occurring amino acid
  misc_feature (1318)..(1318): Xaa can be any naturally occurring amino acid
  misc_feature (1320)..(1320): Xaa can be any naturally occurring amino acid
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNXPXPXPXPXPXPXPMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 166 - protein, 1559 aa, Artificial Sequence
  SYNTHETIC
  misc_feature (1308)..(1308): Xaa can be any naturally occurring amino acid
  misc_feature (1310)..(1310): Xaa can be any naturally occurring amino acid
  misc_feature (1312)..(1312): Xaa can be any naturally occurring amino acid
  misc_feature (1314)..(1314): Xaa can be any naturally occurring amino acid
  misc_feature (1316)..(1316): Xaa can be any naturally occurring amino acid
  misc_feature (1318)..(1318): Xaa can be any naturally occurring amino acid
  misc_feature (1320)..(1320): Xaa can be any naturally occurring amino acid
  misc_feature (1322)..(1322): Xaa can be any naturally occurring amino acid
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNXPXPXPXPXPXPXPXPMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 167 - protein, 1561 aa, Artificial Sequence
  SYNTHETIC
  misc_feature (1308)..(1308): Xaa can be any naturally occurring amino acid
  misc_feature (1310)..(1310): Xaa can be any naturally occurring amino acid
  misc_feature (1312)..(1312): Xaa can be any naturally occurring amino acid
  misc_feature (1314)..(1314): Xaa can be any naturally occurring amino acid
  misc_feature (1316)..(1316): Xaa can be any naturally occurring amino acid
  misc_feature (1318)..(1318): Xaa can be any naturally occurring amino acid
  misc_feature (1320)..(1320): Xaa can be any naturally occurring amino acid
  misc_feature (1322)..(1322): Xaa can be any naturally occurring amino acid
  misc_feature (1324)..(1324): Xaa can be any naturally occurring amino acid
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNXPXPXPXPXPXPXPXPXPMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 168 - protein, 1563 aa, Artificial Sequence
  SYNTHETIC
  misc_feature (1308)..(1308): Xaa can be any naturally occurring amino acid
  misc_feature (1310)..(1310): Xaa can be any naturally occurring amino acid
  misc_feature (1312)..(1312): Xaa can be any naturally occurring amino acid
  misc_feature (1314)..(1314): Xaa can be any naturally occurring amino acid
  misc_feature (1316)..(1316): Xaa can be any naturally occurring amino acid
  misc_feature (1318)..(1318): Xaa can be any naturally occurring amino acid
  misc_feature (1320)..(1320): Xaa can be any naturally occurring amino acid
  misc_feature (1322)..(1322): Xaa can be any naturally occurring amino acid
  misc_feature (1324)..(1324): Xaa can be any naturally occurring amino acid
  misc_feature (1326)..(1326): Xaa can be any naturally occurring amino acid
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNXPXPXPXPXPXPXPXPXPXPMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 169 - protein, 1565 aa, Artificial Sequence
  SYNTHETIC
  misc_feature (1308)..(1308): Xaa can be any naturally occurring amino acid
  misc_feature (1310)..(1310): Xaa can be any naturally occurring amino acid
  misc_feature (1312)..(1312): Xaa can be any naturally occurring amino acid
  misc_feature (1314)..(1314): Xaa can be any naturally occurring amino acid
  misc_feature (1316)..(1316): Xaa can be any naturally occurring amino acid
  misc_feature (1318)..(1318): Xaa can be any naturally occurring amino acid
  misc_feature (1320)..(1320): Xaa can be any naturally occurring amino acid
  misc_feature (1322)..(1322): Xaa can be any naturally occurring amino acid
  misc_feature (1324)..(1324): Xaa can be any naturally occurring amino acid
  misc_feature (1326)..(1326): Xaa can be any naturally occurring amino acid
  misc_feature (1328)..(1328): Xaa can be any naturally occurring amino acid
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNXPXPXPXPXPXPXPXPXPXPXPMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 170 - protein, 1567 aa, Artificial Sequence
  SYNTHETIC
  misc_feature (1308)..(1308): Xaa can be any naturally occurring amino acid
  misc_feature (1310)..(1310): Xaa can be any naturally occurring amino acid
  misc_feature (1312)..(1312): Xaa can be any naturally occurring amino acid
  misc_feature (1314)..(1314): Xaa can be any naturally occurring amino acid
  misc_feature (1316)..(1316): Xaa can be any naturally occurring amino acid
  misc_feature (1318)..(1318): Xaa can be any naturally occurring amino acid
  misc_feature (1320)..(1320): Xaa can be any naturally occurring amino acid
  misc_feature (1322)..(1322): Xaa can be any naturally occurring amino acid
  misc_feature (1324)..(1324): Xaa can be any naturally occurring amino acid
  misc_feature (1326)..(1326): Xaa can be any naturally occurring amino acid
  misc_feature (1328)..(1328): Xaa can be any naturally occurring amino acid
  misc_feature (1330)..(1330): Xaa can be any naturally occurring amino acid
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNXPXPXPXPXPXPXPXPXPXPXPXPMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 171 - protein, 1569 aa, Artificial Sequence
  SYNTHETIC
  misc_feature (1308)..(1308): Xaa can be any naturally occurring amino acid
  misc_feature (1310)..(1310): Xaa can be any naturally occurring amino acid
  misc_feature (1312)..(1312): Xaa can be any naturally occurring amino acid
  misc_feature (1314)..(1314): Xaa can be any naturally occurring amino acid
  misc_feature (1316)..(1316): Xaa can be any naturally occurring amino acid
  misc_feature (1318)..(1318): Xaa can be any naturally occurring amino acid
  misc_feature (1320)..(1320): Xaa can be any naturally occurring amino acid
  misc_feature (1322)..(1322): Xaa can be any naturally occurring amino acid
  misc_feature (1324)..(1324): Xaa can be any naturally occurring amino acid
  misc_feature (1326)..(1326): Xaa can be any naturally occurring amino acid
  misc_feature (1328)..(1328): Xaa can be any naturally occurring amino acid
  misc_feature (1330)..(1330): Xaa can be any naturally occurring amino acid
  misc_feature (1332)..(1332): Xaa can be any naturally occurring amino acid
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNXPXPXPXPXPXPXPXPXPXPXPXPXPMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 172 - protein, 1571 aa, Artificial Sequence
  SYNTHETIC
  misc_feature (1308)..(1308): Xaa can be any naturally occurring amino acid
  misc_feature (1310)..(1310): Xaa can be any naturally occurring amino acid
  misc_feature (1312)..(1312): Xaa can be any naturally occurring amino acid
  misc_feature (1314)..(1314): Xaa can be any naturally occurring amino acid
  misc_feature (1316)..(1316): Xaa can be any naturally occurring amino acid
  misc_feature (1318)..(1318): Xaa can be any naturally occurring amino acid
  misc_feature (1320)..(1320): Xaa can be any naturally occurring amino acid
  misc_feature (1322)..(1322): Xaa can be any naturally occurring amino acid
  misc_feature (1324)..(1324): Xaa can be any naturally occurring amino acid
  misc_feature (1326)..(1326): Xaa can be any naturally occurring amino acid
  misc_feature (1328)..(1328): Xaa can be any naturally occurring amino acid
  misc_feature (1330)..(1330): Xaa can be any naturally occurring amino acid
  misc_feature (1332)..(1332): Xaa can be any naturally occurring amino acid
  misc_feature (1334)..(1334): Xaa can be any naturally occurring amino acid
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNXPXPXPXPXPXPXPXPXPXPXPXPXPXPMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 173 - protein, 1558 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNGGGGSEAAAKGGGGSMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 174 - protein, 1479 aa, Artificial Sequence
  SYNTHETIC
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHGSAGSAAGSGEFMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 175 - protein, 1487 aa, Artificial Sequence
  SYNTHETIC
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHGGGGSGGGGSGGGGSGGGGSMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 176 - protein, 1489 aa, Artificial Sequence
  SYNTHETIC
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHAEAAAKEAAAKEAAAKEAAAKAMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 177 - protein, 1513 aa, Artificial Sequence
  SYNTHETIC
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHAEAAAKEAAAKEAAAKEAAAKALEAEAAAKEAAAKEAAAKEAAAKAMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 178 - protein, 1517 aa, Artificial Sequence
  SYNTHETIC
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHLEAEAAAKEAAAKEAAAKEAAAKALEAEAAAKEAAAKEAAAKEAAAKALEMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 179 - protein, 1470 aa, Artificial Sequence
  SYNTHETIC
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHAPAMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 180 - protein, 1472 aa, Artificial Sequence
  SYNTHETIC
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHAPAPAMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 181 - protein, 1474 aa, Artificial Sequence
  SYNTHETIC
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHAPAPAPAMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 182 - protein, 1476 aa, Artificial Sequence
  SYNTHETIC
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHAPAPAPAPAMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 183 - protein, 1478 aa, Artificial Sequence
  SYNTHETIC
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHAPAPAPAPAPAMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 184 - protein, 1480 aa, Artificial Sequence
  SYNTHETIC
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHAPAPAPAPAPAPAMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 185 - protein, 1482 aa, Artificial Sequence
  SYNTHETIC
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHAPAPAPAPAPAPAPAMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 186 - protein, 1484 aa, Artificial Sequence
  SYNTHETIC
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHAPAPAPAPAPAPAPAPAMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 187 - protein, 1486 aa, Artificial Sequence
  SYNTHETIC
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHAPAPAPAPAPAPAPAPAPAMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 188 - protein, 1565 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSMSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHAPAPAPAPAPAPAPAPAPAPAMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 189 - protein, 1490 aa, Artificial Sequence
  SYNTHETIC
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHAPAPAPAPAPAPAPAPAPAPAPAMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 190 - protein, 1492 aa, Artificial Sequence
  SYNTHETIC
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHAPAPAPAPAPAPAPAPAPAPAPAPAMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 191 - protein, 1494 aa, Artificial Sequence
  SYNTHETIC
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHAPAPAPAPAPAPAPAPAPAPAPAPAPAMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 192 - protein, 1496 aa, Artificial Sequence
  SYNTHETIC
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHAPAPAPAPAPAPAPAPAPAPAPAPAPAPAMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 193 - protein, 1469 aa, Artificial Sequence
  SYNTHETIC
  misc_feature (1229)..(1229): Xaa can be any naturally occurring amino acid
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHXPMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 194 - protein, 1471 aa, Artificial Sequence
  SYNTHETIC
  misc_feature (1229)..(1229): Xaa can be any naturally occurring amino acid
  misc_feature (1231)..(1231): Xaa can be any naturally occurring amino acid
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHXPXPMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 195 - protein, 1473 aa, Artificial Sequence
  SYNTHETIC
  misc_feature (1229)..(1229): Xaa can be any naturally occurring amino acid
  misc_feature (1231)..(1231): Xaa can be any naturally occurring amino acid
  misc_feature (1233)..(1233): Xaa can be any naturally occurring amino acid
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHXPXPXPMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 196 - protein, 1475 aa, Artificial Sequence
  SYNTHETIC
  misc_feature (1229)..(1229): Xaa can be any naturally occurring amino acid
  misc_feature (1231)..(1231): Xaa can be any naturally occurring amino acid
  misc_feature (1233)..(1233): Xaa can be any naturally occurring amino acid
  misc_feature (1235)..(1235): Xaa can be any naturally occurring amino acid
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHXPXPXPXPMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 197 - protein, 1477 aa, Artificial Sequence
  SYNTHETIC
  misc_feature (1229)..(1229): Xaa can be any naturally occurring amino acid
  misc_feature (1231)..(1231): Xaa can be any naturally occurring amino acid
  misc_feature (1233)..(1233): Xaa can be any naturally occurring amino acid
  misc_feature (1235)..(1235): Xaa can be any naturally occurring amino acid
  misc_feature (1237)..(1237): Xaa can be any naturally occurring amino acid
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHXPXPXPXPXPMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 198 - protein, 1479 aa, Artificial Sequence
  SYNTHETIC
  misc_feature (1229)..(1229): Xaa can be any naturally occurring amino acid
  misc_feature (1231)..(1231): Xaa can be any naturally occurring amino acid
  misc_feature (1233)..(1233): Xaa can be any naturally occurring amino acid
  misc_feature (1235)..(1235): Xaa can be any naturally occurring amino acid
  misc_feature (1237)..(1237): Xaa can be any naturally occurring amino acid
  misc_feature (1239)..(1239): Xaa can be any naturally occurring amino acid
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHXPXPXPXPXPXPMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 199 - protein, 1481 aa, Artificial Sequence
  SYNTHETIC
  misc_feature (1229)..(1229): Xaa can be any naturally occurring amino acid
  misc_feature (1231)..(1231): Xaa can be any naturally occurring amino acid
  misc_feature (1233)..(1233): Xaa can be any naturally occurring amino acid
  misc_feature (1235)..(1235): Xaa can be any naturally occurring amino acid
  misc_feature (1237)..(1237): Xaa can be any naturally occurring amino acid
  misc_feature (1239)..(1239): Xaa can be any naturally occurring amino acid
  misc_feature (1241)..(1241): Xaa can be any naturally occurring amino acid
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHXPXPXPXPXPXPXPMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 200 - protein, 1483 aa, Artificial Sequence
  SYNTHETIC
  misc_feature (1229)..(1229): Xaa can be any naturally occurring amino acid
  misc_feature (1231)..(1231): Xaa can be any naturally occurring amino acid
  misc_feature (1233)..(1233): Xaa can be any naturally occurring amino acid
  misc_feature (1235)..(1235): Xaa can be any naturally occurring amino acid
  misc_feature (1237)..(1237): Xaa can be any naturally occurring amino acid
  misc_feature (1239)..(1239): Xaa can be any naturally occurring amino acid
  misc_feature (1241)..(1241): Xaa can be any naturally occurring amino acid
  misc_feature (1243)..(1243): Xaa can be any naturally occurring amino acid
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHXPXPXPXPXPXPXPXPMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 201 - protein, 1485 aa, Artificial Sequence
  SYNTHETIC
  misc_feature (1229)..(1229): Xaa can be any naturally occurring amino acid
  misc_feature (1231)..(1231): Xaa can be any naturally occurring amino acid
  misc_feature (1233)..(1233): Xaa can be any naturally occurring amino acid
  misc_feature (1235)..(1235): Xaa can be any naturally occurring amino acid
  misc_feature (1237)..(1237): Xaa can be any naturally occurring amino acid
  misc_feature (1239)..(1239): Xaa can be any naturally occurring amino acid
  misc_feature (1241)..(1241): Xaa can be any naturally occurring amino acid
  misc_feature (1243)..(1243): Xaa can be any naturally occurring amino acid
  misc_feature (1245)..(1245): Xaa can be any naturally occurring amino acid
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHXPXPXPXPXPXPXPXPXPMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 202 - protein, 1487 aa, Artificial Sequence
  SYNTHETIC
  misc_feature (1229)..(1229): Xaa can be any naturally occurring amino acid
  misc_feature (1231)..(1231): Xaa can be any naturally occurring amino acid
  misc_feature (1233)..(1233): Xaa can be any naturally occurring amino acid
  misc_feature (1235)..(1235): Xaa can be any naturally occurring amino acid
  misc_feature (1237)..(1237): Xaa can be any naturally occurring amino acid
  misc_feature (1239)..(1239): Xaa can be any naturally occurring amino acid
  misc_feature (1241)..(1241): Xaa can be any naturally occurring amino acid
  misc_feature (1243)..(1243): Xaa can be any naturally occurring amino acid
  misc_feature (1245)..(1245): Xaa can be any naturally occurring amino acid
  misc_feature (1247)..(1247): Xaa can be any naturally occurring amino acid
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHXPXPXPXPXPXPXPXPXPXPMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 203 - protein, 1489 aa, Artificial Sequence
  SYNTHETIC
  misc_feature (1229)..(1229): Xaa can be any naturally occurring amino acid
  misc_feature (1231)..(1231): Xaa can be any naturally occurring amino acid
  misc_feature (1233)..(1233): Xaa can be any naturally occurring amino acid
  misc_feature (1235)..(1235): Xaa can be any naturally occurring amino acid
  misc_feature (1237)..(1237): Xaa can be any naturally occurring amino acid
  misc_feature (1239)..(1239): Xaa can be any naturally occurring amino acid
  misc_feature (1241)..(1241): Xaa can be any naturally occurring amino acid
  misc_feature (1243)..(1243): Xaa can be any naturally occurring amino acid
  misc_feature (1245)..(1245): Xaa can be any naturally occurring amino acid
  misc_feature (1247)..(1247): Xaa can be any naturally occurring amino acid
  misc_feature (1249)..(1249): Xaa can be any naturally occurring amino acid
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHXPXPXPXPXPXPXPXPXPXPXPMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 204 - protein, 1491 aa, Artificial Sequence
  SYNTHETIC
  misc_feature (1229)..(1229): Xaa can be any naturally occurring amino acid
  misc_feature (1231)..(1231): Xaa can be any naturally occurring amino acid
  misc_feature (1233)..(1233): Xaa can be any naturally occurring amino acid
  misc_feature (1235)..(1235): Xaa can be any naturally occurring amino acid
  misc_feature (1237)..(1237): Xaa can be any naturally occurring amino acid
  misc_feature (1239)..(1239): Xaa can be any naturally occurring amino acid
  misc_feature (1241)..(1241): Xaa can be any naturally occurring amino acid
  misc_feature (1243)..(1243): Xaa can be any naturally occurring amino acid
  misc_feature (1245)..(1245): Xaa can be any naturally occurring amino acid
  misc_feature (1247)..(1247): Xaa can be any naturally occurring amino acid
  misc_feature (1249)..(1249): Xaa can be any naturally occurring amino acid
  misc_feature (1251)..(1251): Xaa can be any naturally occurring amino acid
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHXPXPXPXPXPXPXPXPXPXPXPXPMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 205 - protein, 1493 aa, Artificial Sequence
  SYNTHETIC
  misc_feature (1229)..(1229): Xaa can be any naturally occurring amino acid
  misc_feature (1231)..(1231): Xaa can be any naturally occurring amino acid
  misc_feature (1233)..(1233): Xaa can be any naturally occurring amino acid
  misc_feature (1235)..(1235): Xaa can be any naturally occurring amino acid
  misc_feature (1237)..(1237): Xaa can be any naturally occurring amino acid
  misc_feature (1239)..(1239): Xaa can be any naturally occurring amino acid
  misc_feature (1241)..(1241): Xaa can be any naturally occurring amino acid
  misc_feature (1243)..(1243): Xaa can be any naturally occurring amino acid
  misc_feature (1245)..(1245): Xaa can be any naturally occurring amino acid
  misc_feature (1247)..(1247): Xaa can be any naturally occurring amino acid
  misc_feature (1249)..(1249): Xaa can be any naturally occurring amino acid
  misc_feature (1251)..(1251): Xaa can be any naturally occurring amino acid
  misc_feature (1253)..(1253): Xaa can be any naturally occurring amino acid
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHXPXPXPXPXPXPXPXPXPXPXPXPXPMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 206 - protein, 1495 aa, Artificial Sequence
  SYNTHETIC
  misc_feature (1229)..(1229): Xaa can be any naturally occurring amino acid
  misc_feature (1231)..(1231): Xaa can be any naturally occurring amino acid
  misc_feature (1233)..(1233): Xaa can be any naturally occurring amino acid
  misc_feature (1235)..(1235): Xaa can be any naturally occurring amino acid
  misc_feature (1237)..(1237): Xaa can be any naturally occurring amino acid
  misc_feature (1239)..(1239): Xaa can be any naturally occurring amino acid
  misc_feature (1241)..(1241): Xaa can be any naturally occurring amino acid
  misc_feature (1243)..(1243): Xaa can be any naturally occurring amino acid
  misc_feature (1245)..(1245): Xaa can be any naturally occurring amino acid
  misc_feature (1247)..(1247): Xaa can be any naturally occurring amino acid
  misc_feature (1249)..(1249): Xaa can be any naturally occurring amino acid
  misc_feature (1251)..(1251): Xaa can be any naturally occurring amino acid
  misc_feature (1253)..(1253): Xaa can be any naturally occurring amino acid
  misc_feature (1255)..(1255): Xaa can be any naturally occurring amino acid
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHXPXPXPXPXPXPXPXPXPXPXPXPXPXPMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 207 - protein, 1482 aa, Artificial Sequence
  SYNTHETIC
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHGGGGSEAAAKGGGGSMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 208 - protein, 1476 aa, Artificial Sequence
  SYNTHETIC
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHGSAGSAAGSGEFMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 209 - protein, 1484 aa, Artificial Sequence
  SYNTHETIC
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHGGGGSGGGGSGGGGSGGGGSMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 210 - protein, 1486 aa, Artificial Sequence
  SYNTHETIC
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHAEAAAKEAAAKEAAAKEAAAKAMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 211 - protein, 1510 aa, Artificial Sequence
  SYNTHETIC
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHAEAAAKEAAAKEAAAKEAAAKALEAEAAAKEAAAKEAAAKEAAAKAMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 212 - protein, 1514 aa, Artificial Sequence
  SYNTHETIC
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHLEAEAAAKEAAAKEAAAKEAAAKALEAEAAAKEAAAKEAAAKEAAAKALEMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 213 - protein, 1467 aa, Artificial Sequence
  SYNTHETIC
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHAPAMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 214 - protein, 1469 aa, Artificial Sequence
  SYNTHETIC
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHAPAPAMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 215 - protein, 1471 aa, Artificial Sequence
  SYNTHETIC
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHAPAPAPAMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 216 - protein, 1473 aa, Artificial Sequence
  SYNTHETIC
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHAPAPAPAPAMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 217 - protein, 1475 aa, Artificial Sequence
  SYNTHETIC
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHAPAPAPAPAPAMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 218 - protein, 1477 aa, Artificial Sequence
  SYNTHETIC
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHAPAPAPAPAPAPAMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 219 - protein, 1479 aa, Artificial Sequence
  SYNTHETIC
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHAPAPAPAPAPAPAPAMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 220 - protein, 1481 aa, Artificial Sequence
  SYNTHETIC
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHAPAPAPAPAPAPAPAPAMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 221 - protein, 1483 aa, Artificial Sequence
  SYNTHETIC
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHAPAPAPAPAPAPAPAPAPAMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 222 - protein, 1485 aa, Artificial Sequence
  SYNTHETIC
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHAPAPAPAPAPAPAPAPAPAPAMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 223 - protein, 1487 aa, Artificial Sequence
  SYNTHETIC
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHAPAPAPAPAPAPAPAPAPAPAPAMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 224 - protein, 1489 aa, Artificial Sequence
  SYNTHETIC
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHAPAPAPAPAPAPAPAPAPAPAPAPAMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 225 - protein, 1491 aa, Artificial Sequence
  SYNTHETIC
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHAPAPAPAPAPAPAPAPAPAPAPAPAPAMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 226 - protein, 1493 aa, Artificial Sequence
  SYNTHETIC
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHAPAPAPAPAPAPAPAPAPAPAPAPAPAPAMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 227 - protein, 1466 aa, Artificial Sequence
  SYNTHETIC
  misc_feature (1229)..(1229): Xaa can be any naturally occurring amino acid
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHXPMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 228 - protein, 1468 aa, Artificial Sequence
  SYNTHETIC
  misc_feature (1229)..(1229): Xaa can be any naturally occurring amino acid
  misc_feature (1231)..(1231): Xaa can be any naturally occurring amino acid
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHXPXPMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 229 - protein, 1470 aa, Artificial Sequence
  SYNTHETIC
  misc_feature (1229)..(1229): Xaa can be any naturally occurring amino acid
  misc_feature (1231)..(1231): Xaa can be any naturally occurring amino acid
  misc_feature (1233)..(1233): Xaa can be any naturally occurring amino acid
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHXPXPXPMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 230 - protein, 1472 aa, Artificial Sequence
  SYNTHETIC
  misc_feature (1229)..(1229): Xaa can be any naturally occurring amino acid
  misc_feature (1231)..(1231): Xaa can be any naturally occurring amino acid
  misc_feature (1233)..(1233): Xaa can be any naturally occurring amino acid
  misc_feature (1235)..(1235): Xaa can be any naturally occurring amino acid
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHXPXPXPXPMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 231 - protein, 1474 aa, Artificial Sequence
  SYNTHETIC
  misc_feature (1229)..(1229): Xaa can be any naturally occurring amino acid
  misc_feature (1231)..(1231): Xaa can be any naturally occurring amino acid
  misc_feature (1233)..(1233): Xaa can be any naturally occurring amino acid
  misc_feature (1235)..(1235): Xaa can be any naturally occurring amino acid
  misc_feature (1237)..(1237): Xaa can be any naturally occurring amino acid
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHXPXPXPXPXPMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 232 - protein, 1476 aa, Artificial Sequence
  SYNTHETIC
  misc_feature (1229)..(1229): Xaa can be any naturally occurring amino acid
  misc_feature (1231)..(1231): Xaa can be any naturally occurring amino acid
  misc_feature (1233)..(1233): Xaa can be any naturally occurring amino acid
  misc_feature (1235)..(1235): Xaa can be any naturally occurring amino acid
  misc_feature (1237)..(1237): Xaa can be any naturally occurring amino acid
  misc_feature (1239)..(1239): Xaa can be any naturally occurring amino acid
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHXPXPXPXPXPXPMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 233 - protein, 1478 aa, Artificial Sequence
  SYNTHETIC
  misc_feature (1229)..(1229): Xaa can be any naturally occurring amino acid
  misc_feature (1231)..(1231): Xaa can be any naturally occurring amino acid
  misc_feature (1233)..(1233): Xaa can be any naturally occurring amino acid
  misc_feature (1235)..(1235): Xaa can be any naturally occurring amino acid
  misc_feature (1237)..(1237): Xaa can be any naturally occurring amino acid
  misc_feature (1239)..(1239): Xaa can be any naturally occurring amino acid
  misc_feature (1241)..(1241): Xaa can be any naturally occurring amino acid
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHXPXPXPXPXPXPXPMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 234 - protein, 1480 aa, Artificial Sequence
  SYNTHETIC
  misc_feature (1229)..(1229): Xaa can be any naturally occurring amino acid
  misc_feature (1231)..(1231): Xaa can be any naturally occurring amino acid
  misc_feature (1233)..(1233): Xaa can be any naturally occurring amino acid
  misc_feature (1235)..(1235): Xaa can be any naturally occurring amino acid
  misc_feature (1237)..(1237): Xaa can be any naturally occurring amino acid
  misc_feature (1239)..(1239): Xaa can be any naturally occurring amino acid
  misc_feature (1241)..(1241): Xaa can be any naturally occurring amino acid
  misc_feature (1243)..(1243): Xaa can be any naturally occurring amino acid
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHXPXPXPXPXPXPXPXPMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 235 - protein, 1482 aa, Artificial Sequence
  SYNTHETIC
  misc_feature (1229)..(1229): Xaa can be any naturally occurring amino acid
  misc_feature (1231)..(1231): Xaa can be any naturally occurring amino acid
  misc_feature (1233)..(1233): Xaa can be any naturally occurring amino acid
  misc_feature (1235)..(1235): Xaa can be any naturally occurring amino acid
  misc_feature (1237)..(1237): Xaa can be any naturally occurring amino acid
  misc_feature (1239)..(1239): Xaa can be any naturally occurring amino acid
  misc_feature (1241)..(1241): Xaa can be any naturally occurring amino acid
  misc_feature (1243)..(1243): Xaa can be any naturally occurring amino acid
  misc_feature (1245)..(1245): Xaa can be any naturally occurring amino acid
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHXPXPXPXPXPXPXPXPXPMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 236 - protein, 1484 aa, Artificial Sequence
  SYNTHETIC
  misc_feature (1229)..(1229): Xaa can be any naturally occurring amino acid
  misc_feature (1231)..(1231): Xaa can be any naturally occurring amino acid
  misc_feature (1233)..(1233): Xaa can be any naturally occurring amino acid
  misc_feature (1235)..(1235): Xaa can be any naturally occurring amino acid
  misc_feature (1237)..(1237): Xaa can be any naturally occurring amino acid
  misc_feature (1239)..(1239): Xaa can be any naturally occurring amino acid
  misc_feature (1241)..(1241): Xaa can be any naturally occurring amino acid
  misc_feature (1243)..(1243): Xaa can be any naturally occurring amino acid
  misc_feature (1245)..(1245): Xaa can be any naturally occurring amino acid
  misc_feature (1247)..(1247): Xaa can be any naturally occurring amino acid
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHXPXPXPXPXPXPXPXPXPXPMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 237 - protein, 1486 aa, Artificial Sequence
  SYNTHETIC
  misc_feature (1229)..(1229): Xaa can be any naturally occurring amino acid
  misc_feature (1231)..(1231): Xaa can be any naturally occurring amino acid
  misc_feature (1233)..(1233): Xaa can be any naturally occurring amino acid
  misc_feature (1235)..(1235): Xaa can be any naturally occurring amino acid
  misc_feature (1237)..(1237): Xaa can be any naturally occurring amino acid
  misc_feature (1239)..(1239): Xaa can be any naturally occurring amino acid
  misc_feature (1241)..(1241): Xaa can be any naturally occurring amino acid
  misc_feature (1243)..(1243): Xaa can be any naturally occurring amino acid
  misc_feature (1245)..(1245): Xaa can be any naturally occurring amino acid
  misc_feature (1247)..(1247): Xaa can be any naturally occurring amino acid
  misc_feature (1249)..(1249): Xaa can be any naturally occurring amino acid
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHXPXPXPXPXPXPXPXPXPXPXPMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 238 - protein, 1488 aa, Artificial Sequence
  SYNTHETIC
  misc_feature (1229)..(1229): Xaa can be any naturally occurring amino acid
  misc_feature (1231)..(1231): Xaa can be any naturally occurring amino acid
  misc_feature (1233)..(1233): Xaa can be any naturally occurring amino acid
  misc_feature (1235)..(1235): Xaa can be any naturally occurring amino acid
  misc_feature (1237)..(1237): Xaa can be any naturally occurring amino acid
  misc_feature (1239)..(1239): Xaa can be any naturally occurring amino acid
  misc_feature (1241)..(1241): Xaa can be any naturally occurring amino acid
  misc_feature (1243)..(1243): Xaa can be any naturally occurring amino acid
  misc_feature (1245)..(1245): Xaa can be any naturally occurring amino acid
  misc_feature (1247)..(1247): Xaa can be any naturally occurring amino acid
  misc_feature (1249)..(1249): Xaa can be any naturally occurring amino acid
  misc_feature (1251)..(1251): Xaa can be any naturally occurring amino acid
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHXPXPXPXPXPXPXPXPXPXPXPXPMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 239 - protein, 1490 aa, Artificial Sequence
  SYNTHETIC
  misc_feature (1229)..(1229): Xaa can be any naturally occurring amino acid
  misc_feature (1231)..(1231): Xaa can be any naturally occurring amino acid
  misc_feature (1233)..(1233): Xaa can be any naturally occurring amino acid
  misc_feature (1235)..(1235): Xaa can be any naturally occurring amino acid
  misc_feature (1237)..(1237): Xaa can be any naturally occurring amino acid
  misc_feature (1239)..(1239): Xaa can be any naturally occurring amino acid
  misc_feature (1241)..(1241): Xaa can be any naturally occurring amino acid
  misc_feature (1243)..(1243): Xaa can be any naturally occurring amino acid
  misc_feature (1245)..(1245): Xaa can be any naturally occurring amino acid
  misc_feature (1247)..(1247): Xaa can be any naturally occurring amino acid
  misc_feature (1249)..(1249): Xaa can be any naturally occurring amino acid
  misc_feature (1251)..(1251): Xaa can be any naturally occurring amino acid
  misc_feature (1253)..(1253): Xaa can be any naturally occurring amino acid
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHXPXPXPXPXPXPXPXPXPXPXPXPXPMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 240 - protein, 1492 aa, Artificial Sequence
  SYNTHETIC
  misc_feature (1229)..(1229): Xaa can be any naturally occurring amino acid
  misc_feature (1231)..(1231): Xaa can be any naturally occurring amino acid
  misc_feature (1233)..(1233): Xaa can be any naturally occurring amino acid
  misc_feature (1235)..(1235): Xaa can be any naturally occurring amino acid
  misc_feature (1237)..(1237): Xaa can be any naturally occurring amino acid
  misc_feature (1239)..(1239): Xaa can be any naturally occurring amino acid
  misc_feature (1241)..(1241): Xaa can be any naturally occurring amino acid
  misc_feature (1243)..(1243): Xaa can be any naturally occurring amino acid
  misc_feature (1245)..(1245): Xaa can be any naturally occurring amino acid
  misc_feature (1247)..(1247): Xaa can be any naturally occurring amino acid
  misc_feature (1249)..(1249): Xaa can be any naturally occurring amino acid
  misc_feature (1251)..(1251): Xaa can be any naturally occurring amino acid
  misc_feature (1253)..(1253): Xaa can be any naturally occurring amino acid
  misc_feature (1255)..(1255): Xaa can be any naturally occurring amino acid
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHXPXPXPXPXPXPXPXPXPXPXPXPXPXPMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 241 - protein, 1479 aa, Artificial Sequence
  SYNTHETIC
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHGGGGSEAAAKGGGGSMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 242 - protein, 1479 aa, Artificial Sequence
  SYNTHETIC
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYLLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHGSAGSAAGSGEFMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 243 - protein, 1487 aa, Artificial Sequence
  SYNTHETIC
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYLLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHGGGGSGGGGSGGGGSGGGGSMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 244 - protein, 1489 aa, Artificial Sequence
  SYNTHETIC
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYLLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHAEAAAKEAAAKEAAAKEAAAKAMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 245 - protein, 1513 aa, Artificial Sequence
  SYNTHETIC
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYLLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHAEAAAKEAAAKEAAAKEAAAKALEAEAAAKEAAAKEAAAKEAAAKAMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 246 - protein, 1517 aa, Artificial Sequence
  SYNTHETIC
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYLLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHLEAEAAAKEAAAKEAAAKEAAAKALEAEAAAKEAAAKEAAAKEAAAKALEMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 247 - protein, 1470 aa, Artificial Sequence
  SYNTHETIC
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYLLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHAPAMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 248 - protein, 1472 aa, Artificial Sequence
  SYNTHETIC
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYLLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHAPAPAMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 249 - protein, 1474 aa, Artificial Sequence
  SYNTHETIC
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYLLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHAPAPAPAMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 250 - protein, 1476 aa, Artificial Sequence
  SYNTHETIC
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYLLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHAPAPAPAPAMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 251 - protein, 1478 aa, Artificial Sequence
  SYNTHETIC
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYLLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHAPAPAPAPAPAMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 252 - protein, 1480 aa, Artificial Sequence
  SYNTHETIC
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYLLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHAPAPAPAPAPAPAMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 253 - protein, 1482 aa, Artificial Sequence
  SYNTHETIC
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYLLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHAPAPAPAPAPAPAPAMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 254 - protein, 1484 aa, Artificial Sequence
  SYNTHETIC
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYLLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHAPAPAPAPAPAPAPAPAMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 255 - protein, 1486 aa, Artificial Sequence
  SYNTHETIC
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYLLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHAPAPAPAPAPAPAPAPAPAMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 256 - protein, 1565 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSMSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYLLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHAPAPAPAPAPAPAPAPAPAPAMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 257 - protein, 1490 aa, Artificial Sequence
  SYNTHETIC
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYLLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHAPAPAPAPAPAPAPAPAPAPAPAMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 258 - protein, 1492 aa, Artificial Sequence
  SYNTHETIC
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYLLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHAPAPAPAPAPAPAPAPAPAPAPAPAMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 259 - protein, 1494 aa, Artificial Sequence
  SYNTHETIC
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYLLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHAPAPAPAPAPAPAPAPAPAPAPAPAPAMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 260 - protein, 1496 aa, Artificial Sequence
  SYNTHETIC
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYLLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHAPAPAPAPAPAPAPAPAPAPAPAPAPAPAMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 261 - protein, 1469 aa, Artificial Sequence
  SYNTHETIC
  misc_feature (1229)..(1229): Xaa can be any naturally occurring amino acid
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYLLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHXPMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 262 - protein, 1471 aa, Artificial Sequence
  SYNTHETIC
  misc_feature (1229)..(1229): Xaa can be any naturally occurring amino acid
  misc_feature (1231)..(1231): Xaa can be any naturally occurring amino acid
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYLLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHXPXPMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 263 - protein, 1473 aa, Artificial Sequence
  SYNTHETIC
  misc_feature (1229)..(1229): Xaa can be any naturally occurring amino acid
  misc_feature (1231)..(1231): Xaa can be any naturally occurring amino acid
  misc_feature (1233)..(1233): Xaa can be any naturally occurring amino acid
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYLLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHXPXPXPMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 264 - protein, 1475 aa, Artificial Sequence
  SYNTHETIC
  misc_feature (1229)..(1229): Xaa can be any naturally occurring amino acid
  misc_feature (1231)..(1231): Xaa can be any naturally occurring amino acid
  misc_feature (1233)..(1233): Xaa can be any naturally occurring amino acid
  misc_feature (1235)..(1235): Xaa can be any naturally occurring amino acid
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYLLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHXPXPXPXPMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 265 - protein, 1477 aa, Artificial Sequence
  SYNTHETIC
  misc_feature (1229)..(1229): Xaa can be any naturally occurring amino acid
  misc_feature (1231)..(1231): Xaa can be any naturally occurring amino acid
  misc_feature (1233)..(1233): Xaa can be any naturally occurring amino acid
  misc_feature (1235)..(1235): Xaa can be any naturally occurring amino acid
  misc_feature (1237)..(1237): Xaa can be any naturally occurring amino acid
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYLLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHXPXPXPXPXPMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 266 - protein, 1479 aa, Artificial Sequence
  SYNTHETIC
  misc_feature (1229)..(1229): Xaa can be any naturally occurring amino acid
  misc_feature (1231)..(1231): Xaa can be any naturally occurring amino acid
  misc_feature (1233)..(1233): Xaa can be any naturally occurring amino acid
  misc_feature (1235)..(1235): Xaa can be any naturally occurring amino acid
  misc_feature (1237)..(1237): Xaa can be any naturally occurring amino acid
  misc_feature (1239)..(1239): Xaa can be any naturally occurring amino acid
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYLLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHXPXPXPXPXPXPMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 267 - protein, 1481 aa, Artificial Sequence
  SYNTHETIC
  misc_feature (1229)..(1229): Xaa can be any naturally occurring amino acid
  misc_feature (1231)..(1231): Xaa can be any naturally occurring amino acid
  misc_feature (1233)..(1233): Xaa can be any naturally occurring amino acid
  misc_feature (1235)..(1235): Xaa can be any naturally occurring amino acid
  misc_feature (1237)..(1237): Xaa can be any naturally occurring amino acid
  misc_feature (1239)..(1239): Xaa can be any naturally occurring amino acid
  misc_feature (1241)..(1241): Xaa can be any naturally occurring amino acid
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYLLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHXPXPXPXPXPXPXPMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 268 - protein, 1483 aa, Artificial Sequence
  SYNTHETIC
  misc_feature (1229)..(1229): Xaa can be any naturally occurring amino acid
  misc_feature (1231)..(1231): Xaa can be any naturally occurring amino acid
  misc_feature (1233)..(1233): Xaa can be any naturally occurring amino acid
  misc_feature (1235)..(1235): Xaa can be any naturally occurring amino acid
  misc_feature (1237)..(1237): Xaa can be any naturally occurring amino acid
  misc_feature (1239)..(1239): Xaa can be any naturally occurring amino acid
  misc_feature (1241)..(1241): Xaa can be any naturally occurring amino acid
  misc_feature (1243)..(1243): Xaa can be any naturally occurring amino acid
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYLLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHXPXPXPXPXPXPXPXPMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 269 - protein, 1485 aa, Artificial Sequence
  SYNTHETIC
  misc_feature (1229)..(1229): Xaa can be any naturally occurring amino acid
  misc_feature (1231)..(1231): Xaa can be any naturally occurring amino acid
  misc_feature (1233)..(1233): Xaa can be any naturally occurring amino acid
  misc_feature (1235)..(1235): Xaa can be any naturally occurring amino acid
  misc_feature (1237)..(1237): Xaa can be any naturally occurring amino acid
  misc_feature (1239)..(1239): Xaa can be any naturally occurring amino acid
  misc_feature (1241)..(1241): Xaa can be any naturally occurring amino acid
  misc_feature (1243)..(1243): Xaa can be any naturally occurring amino acid
  misc_feature (1245)..(1245): Xaa can be any naturally occurring amino acid
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYLLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHXPXPXPXPXPXPXPXPXPMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 270 - protein, 1487 aa, Artificial Sequence
  SYNTHETIC
  misc_feature (1229)..(1229): Xaa can be any naturally occurring amino acid
  misc_feature (1231)..(1231): Xaa can be any naturally occurring amino acid
  misc_feature (1233)..(1233): Xaa can be any naturally occurring amino acid
  misc_feature (1235)..(1235): Xaa can be any naturally occurring amino acid
  misc_feature (1237)..(1237): Xaa can be any naturally occurring amino acid
  misc_feature (1239)..(1239): Xaa can be any naturally occurring amino acid
  misc_feature (1241)..(1241): Xaa can be any naturally occurring amino acid
  misc_feature (1243)..(1243): Xaa can be any naturally occurring amino acid
  misc_feature (1245)..(1245): Xaa can be any naturally occurring amino acid
  misc_feature (1247)..(1247): Xaa can be any naturally occurring amino acid
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYLLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHXPXPXPXPXPXPXPXPXPXPMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 271 - protein, 1489 aa, Artificial Sequence
  SYNTHETIC
  misc_feature (1229)..(1229): Xaa can be any naturally occurring amino acid
  misc_feature (1231)..(1231): Xaa can be any naturally occurring amino acid
  misc_feature (1233)..(1233): Xaa can be any naturally occurring amino acid
  misc_feature (1235)..(1235): Xaa can be any naturally occurring amino acid
  misc_feature (1237)..(1237): Xaa can be any naturally occurring amino acid
  misc_feature (1239)..(1239): Xaa can be any naturally occurring amino acid
  misc_feature (1241)..(1241): Xaa can be any naturally occurring amino acid
  misc_feature (1243)..(1243): Xaa can be any naturally occurring amino acid
  misc_feature (1245)..(1245): Xaa can be any naturally occurring amino acid
  misc_feature (1247)..(1247): Xaa can be any naturally occurring amino acid
  misc_feature (1249)..(1249): Xaa can be any naturally occurring amino acid
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYLLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHXPXPXPXPXPXPXPXPXPXPXPMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 272 - protein, 1491 aa, Artificial Sequence
  SYNTHETIC
  misc_feature (1229)..(1229): Xaa can be any naturally occurring amino acid
  misc_feature (1231)..(1231): Xaa can be any naturally occurring amino acid
  misc_feature (1233)..(1233): Xaa can be any naturally occurring amino acid
  misc_feature (1235)..(1235): Xaa can be any naturally occurring amino acid
  misc_feature (1237)..(1237): Xaa can be any naturally occurring amino acid
  misc_feature (1239)..(1239): Xaa can be any naturally occurring amino acid
  misc_feature (1241)..(1241): Xaa can be any naturally occurring amino acid
  misc_feature (1243)..(1243): Xaa can be any naturally occurring amino acid
  misc_feature (1245)..(1245): Xaa can be any naturally occurring amino acid
  misc_feature (1247)..(1247): Xaa can be any naturally occurring amino acid
  misc_feature (1249)..(1249): Xaa can be any naturally occurring amino acid
  misc_feature (1251)..(1251): Xaa can be any naturally occurring amino acid
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYLLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHXPXPXPXPXPXPXPXPXPXPXPXPMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 273 - protein, 1493 aa, Artificial Sequence
  SYNTHETIC
  misc_feature (1229)..(1229): Xaa can be any naturally occurring amino acid
  misc_feature (1231)..(1231): Xaa can be any naturally occurring amino acid
  misc_feature (1233)..(1233): Xaa can be any naturally occurring amino acid
  misc_feature (1235)..(1235): Xaa can be any naturally occurring amino acid
  misc_feature (1237)..(1237): Xaa can be any naturally occurring amino acid
  misc_feature (1239)..(1239): Xaa can be any naturally occurring amino acid
  misc_feature (1241)..(1241): Xaa can be any naturally occurring amino acid
  misc_feature (1243)..(1243): Xaa can be any naturally occurring amino acid
  misc_feature (1245)..(1245): Xaa can be any naturally occurring amino acid
  misc_feature (1247)..(1247): Xaa can be any naturally occurring amino acid
  misc_feature (1249)..(1249): Xaa can be any naturally occurring amino acid
  misc_feature (1251)..(1251): Xaa can be any naturally occurring amino acid
  misc_feature (1253)..(1253): Xaa can be any naturally occurring amino acid
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYLLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHXPXPXPXPXPXPXPXPXPXPXPXPXPMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 274 - protein, 1495 aa, Artificial Sequence
  SYNTHETIC
  misc_feature (1229)..(1229): Xaa can be any naturally occurring amino acid
  misc_feature (1231)..(1231): Xaa can be any naturally occurring amino acid
  misc_feature (1233)..(1233): Xaa can be any naturally occurring amino acid
  misc_feature (1235)..(1235): Xaa can be any naturally occurring amino acid
  misc_feature (1237)..(1237): Xaa can be any naturally occurring amino acid
  misc_feature (1239)..(1239): Xaa can be any naturally occurring amino acid
  misc_feature (1241)..(1241): Xaa can be any naturally occurring amino acid
  misc_feature (1243)..(1243): Xaa can be any naturally occurring amino acid
  misc_feature (1245)..(1245): Xaa can be any naturally occurring amino acid
  misc_feature (1247)..(1247): Xaa can be any naturally occurring amino acid
  misc_feature (1249)..(1249): Xaa can be any naturally occurring amino acid
  misc_feature (1251)..(1251): Xaa can be any naturally occurring amino acid
  misc_feature (1253)..(1253): Xaa can be any naturally occurring amino acid
  misc_feature (1255)..(1255): Xaa can be any naturally occurring amino acid
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYLLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHXPXPXPXPXPXPXPXPXPXPXPXPXPXPMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 275 - protein, 1482 aa, Artificial Sequence
  SYNTHETIC
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYLLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHGGGGSEAAAKGGGGSMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 276 - protein, 1476 aa, Artificial Sequence
  SYNTHETIC
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYLLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHGSAGSAAGSGEFMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 277 - protein, 1484 aa, Artificial Sequence
  SYNTHETIC
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYLLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHGGGGSGGGGSGGGGSGGGGSMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 278 - protein, 1486 aa, Artificial Sequence
  SYNTHETIC
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYLLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHAEAAAKEAAAKEAAAKEAAAKAMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 279 - protein, 1510 aa, Artificial Sequence
  SYNTHETIC
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYLLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHAEAAAKEAAAKEAAAKEAAAKALEAEAAAKEAAAKEAAAKEAAAKAMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 280 - protein, 1514 aa, Artificial Sequence
  SYNTHETIC
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYLLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHLEAEAAAKEAAAKEAAAKEAAAKALEAEAAAKEAAAKEAAAKEAAAKALEMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 281 - protein, 1467 aa, Artificial Sequence
  SYNTHETIC
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYLLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHAPAMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 282 - protein, 1469 aa, Artificial Sequence
  SYNTHETIC
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYLLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHAPAPAMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 283 - protein, 1471 aa, Artificial Sequence
  SYNTHETIC
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYLLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHAPAPAPAMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 284 - protein, 1473 aa, Artificial Sequence
  SYNTHETIC
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYLLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHAPAPAPAPAMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 285 - protein, 1475 aa, Artificial Sequence
  SYNTHETIC
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYLLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHAPAPAPAPAPAMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 286 - protein, 1477 aa, Artificial Sequence
  SYNTHETIC
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYLLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHAPAPAPAPAPAPAMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 287 - protein, 1479 aa, Artificial Sequence
  SYNTHETIC
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYLLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHAPAPAPAPAPAPAPAMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 288 - protein, 1481 aa, Artificial Sequence
  SYNTHETIC
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYLLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHAPAPAPAPAPAPAPAPAMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 289 - protein, 1483 aa, Artificial Sequence
  SYNTHETIC
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYLLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHAPAPAPAPAPAPAPAPAPAMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 290 - protein, 1485 aa, Artificial Sequence
  SYNTHETIC
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYLLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHAPAPAPAPAPAPAPAPAPAPAMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 291 - protein, 1487 aa, Artificial Sequence
  SYNTHETIC
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYLLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHAPAPAPAPAPAPAPAPAPAPAPAMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 292 - protein, 1489 aa, Artificial Sequence
  SYNTHETIC
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYLLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHAPAPAPAPAPAPAPAPAPAPAPAPAMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 293 - protein, 1491 aa, Artificial Sequence
  SYNTHETIC
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYLLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHAPAPAPAPAPAPAPAPAPAPAPAPAPAMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 294 - protein, 1493 aa, Artificial Sequence
  SYNTHETIC
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYLLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHAPAPAPAPAPAPAPAPAPAPAPAPAPAPAMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 295 - protein, 1466 aa, Artificial Sequence
  SYNTHETIC
  misc_feature (1229)..(1229): Xaa can be any naturally occurring amino acid
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYLLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHXPMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 296 - protein, 1468 aa, Artificial Sequence
  SYNTHETIC
  misc_feature (1229)..(1229): Xaa can be any naturally occurring amino acid
  misc_feature (1231)..(1231): Xaa can be any naturally occurring amino acid
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYLLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHXPXPMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 297 - protein, 1470 aa, Artificial Sequence
  SYNTHETIC
  misc_feature (1229)..(1229): Xaa can be any naturally occurring amino acid
  misc_feature (1231)..(1231): Xaa can be any naturally occurring amino acid
  misc_feature (1233)..(1233): Xaa can be any naturally occurring amino acid
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYLLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHXPXPXPMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 298 - protein, 1472 aa, Artificial Sequence
  SYNTHETIC
  misc_feature (1229)..(1229): Xaa can be any naturally occurring amino acid
  misc_feature (1231)..(1231): Xaa can be any naturally occurring amino acid
  misc_feature (1233)..(1233): Xaa can be any naturally occurring amino acid
  misc_feature (1235)..(1235): Xaa can be any naturally occurring amino acid
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYLLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHXPXPXPXPMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 299 - protein, 1474 aa, Artificial Sequence
  SYNTHETIC
  misc_feature (1229)..(1229): Xaa can be any naturally occurring amino acid
  misc_feature (1231)..(1231): Xaa can be any naturally occurring amino acid
  misc_feature (1233)..(1233): Xaa can be any naturally occurring amino acid
  misc_feature (1235)..(1235): Xaa can be any naturally occurring amino acid
  misc_feature (1237)..(1237): Xaa can be any naturally occurring amino acid
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYLLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHXPXPXPXPXPMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 300 - protein, 1476 aa, Artificial Sequence
  SYNTHETIC
  misc_feature (1229)..(1229): Xaa can be any naturally occurring amino acid
  misc_feature (1231)..(1231): Xaa can be any naturally occurring amino acid
  misc_feature (1233)..(1233): Xaa can be any naturally occurring amino acid
  misc_feature (1235)..(1235): Xaa can be any naturally occurring amino acid
  misc_feature (1237)..(1237): Xaa can be any naturally occurring amino acid
  misc_feature (1239)..(1239): Xaa can be any naturally occurring amino acid
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYLLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHXPXPXPXPXPXPMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 301 - protein, 1478 aa, Artificial Sequence
  SYNTHETIC
  misc_feature (1229)..(1229): Xaa can be any naturally occurring amino acid
  misc_feature (1231)..(1231): Xaa can be any naturally occurring amino acid
  misc_feature (1233)..(1233): Xaa can be any naturally occurring amino acid
  misc_feature (1235)..(1235): Xaa can be any naturally occurring amino acid
  misc_feature (1237)..(1237): Xaa can be any naturally occurring amino acid
  misc_feature (1239)..(1239): Xaa can be any naturally occurring amino acid
  misc_feature (1241)..(1241): Xaa can be any naturally occurring amino acid
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYLLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHXPXPXPXPXPXPXPMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 302 - protein, 1480 aa, Artificial Sequence
  SYNTHETIC
  misc_feature (1229)..(1229): Xaa can be any naturally occurring amino acid
  misc_feature (1231)..(1231): Xaa can be any naturally occurring amino acid
  misc_feature (1233)..(1233): Xaa can be any naturally occurring amino acid
  misc_feature (1235)..(1235): Xaa can be any naturally occurring amino acid
  misc_feature (1237)..(1237): Xaa can be any naturally occurring amino acid
  misc_feature (1239)..(1239): Xaa can be any naturally occurring amino acid
  misc_feature (1241)..(1241): Xaa can be any naturally occurring amino acid
  misc_feature (1243)..(1243): Xaa can be any naturally occurring amino acid
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYLLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHXPXPXPXPXPXPXPXPMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 303 - protein, 1482 aa, Artificial Sequence
  SYNTHETIC
  misc_feature (1229)..(1229): Xaa can be any naturally occurring amino acid
  misc_feature (1231)..(1231): Xaa can be any naturally occurring amino acid
  misc_feature (1233)..(1233): Xaa can be any naturally occurring amino acid
  misc_feature (1235)..(1235): Xaa can be any naturally occurring amino acid
  misc_feature (1237)..(1237): Xaa can be any naturally occurring amino acid
  misc_feature (1239)..(1239): Xaa can be any naturally occurring amino acid
  misc_feature (1241)..(1241): Xaa can be any naturally occurring amino acid
  misc_feature (1243)..(1243): Xaa can be any naturally occurring amino acid
  misc_feature (1245)..(1245): Xaa can be any naturally occurring amino acid
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYLLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHXPXPXPXPXPXPXPXPXPMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 304 - protein, 1484 aa, Artificial Sequence
  SYNTHETIC
  misc_feature (1229)..(1229): Xaa can be any naturally occurring amino acid
  misc_feature (1231)..(1231): Xaa can be any naturally occurring amino acid
  misc_feature (1233)..(1233): Xaa can be any naturally occurring amino acid
  misc_feature (1235)..(1235): Xaa can be any naturally occurring amino acid
  misc_feature (1237)..(1237): Xaa can be any naturally occurring amino acid
  misc_feature (1239)..(1239): Xaa can be any naturally occurring amino acid
  misc_feature (1241)..(1241): Xaa can be any naturally occurring amino acid
  misc_feature (1243)..(1243): Xaa can be any naturally occurring amino acid
  misc_feature (1245)..(1245): Xaa can be any naturally occurring amino acid
  misc_feature (1247)..(1247): Xaa can be any naturally occurring amino acid
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYLLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHXPXPXPXPXPXPXPXPXPXPMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 305 - protein, 1486 aa, Artificial Sequence
  SYNTHETIC
  misc_feature (1229)..(1229): Xaa can be any naturally occurring amino acid
  misc_feature (1231)..(1231): Xaa can be any naturally occurring amino acid
  misc_feature (1233)..(1233): Xaa can be any naturally occurring amino acid
  misc_feature (1235)..(1235): Xaa can be any naturally occurring amino acid
  misc_feature (1237)..(1237): Xaa can be any naturally occurring amino acid
  misc_feature (1239)..(1239): Xaa can be any naturally occurring amino acid
  misc_feature (1241)..(1241): Xaa can be any naturally occurring amino acid
  misc_feature (1243)..(1243): Xaa can be any naturally occurring amino acid
  misc_feature (1245)..(1245): Xaa can be any naturally occurring amino acid
  misc_feature (1247)..(1247): Xaa can be any naturally occurring amino acid
  misc_feature (1249)..(1249): Xaa can be any naturally occurring amino acid
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYLLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHXPXPXPXPXPXPXPXPXPXPXPMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 306 - protein, 1488 aa, Artificial Sequence
  SYNTHETIC
  misc_feature (1229)..(1229): Xaa can be any naturally occurring amino acid
  misc_feature (1231)..(1231): Xaa can be any naturally occurring amino acid
  misc_feature (1233)..(1233): Xaa can be any naturally occurring amino acid
  misc_feature (1235)..(1235): Xaa can be any naturally occurring amino acid
  misc_feature (1237)..(1237): Xaa can be any naturally occurring amino acid
  misc_feature (1239)..(1239): Xaa can be any naturally occurring amino acid
  misc_feature (1241)..(1241): Xaa can be any naturally occurring amino acid
  misc_feature (1243)..(1243): Xaa can be any naturally occurring amino acid
  misc_feature (1245)..(1245): Xaa can be any naturally occurring amino acid
  misc_feature (1247)..(1247): Xaa can be any naturally occurring amino acid
  misc_feature (1249)..(1249): Xaa can be any naturally occurring amino acid
  misc_feature (1251)..(1251): Xaa can be any naturally occurring amino acid
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYLLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHXPXPXPXPXPXPXPXPXPXPXPXPMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 307 - protein, 1490 aa, Artificial Sequence
  SYNTHETIC
  misc_feature (1229)..(1229): Xaa can be any naturally occurring amino acid
  misc_feature (1231)..(1231): Xaa can be any naturally occurring amino acid
  misc_feature (1233)..(1233): Xaa can be any naturally occurring amino acid
  misc_feature (1235)..(1235): Xaa can be any naturally occurring amino acid
  misc_feature (1237)..(1237): Xaa can be any naturally occurring amino acid
  misc_feature (1239)..(1239): Xaa can be any naturally occurring amino acid
  misc_feature (1241)..(1241): Xaa can be any naturally occurring amino acid
  misc_feature (1243)..(1243): Xaa can be any naturally occurring amino acid
  misc_feature (1245)..(1245): Xaa can be any naturally occurring amino acid
  misc_feature (1247)..(1247): Xaa can be any naturally occurring amino acid
  misc_feature (1249)..(1249): Xaa can be any naturally occurring amino acid
  misc_feature (1251)..(1251): Xaa can be any naturally occurring amino acid
  misc_feature (1253)..(1253): Xaa can be any naturally occurring amino acid
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYLLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHXPXPXPXPXPXPXPXPXPXPXPXPXPMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 308 - protein, 1492 aa, Artificial Sequence
  SYNTHETIC
  misc_feature (1229)..(1229): Xaa can be any naturally occurring amino acid
  misc_feature (1231)..(1231): Xaa can be any naturally occurring amino acid
  misc_feature (1233)..(1233): Xaa can be any naturally occurring amino acid
  misc_feature (1235)..(1235): Xaa can be any naturally occurring amino acid
  misc_feature (1237)..(1237): Xaa can be any naturally occurring amino acid
  misc_feature (1239)..(1239): Xaa can be any naturally occurring amino acid
  misc_feature (1241)..(1241): Xaa can be any naturally occurring amino acid
  misc_feature (1243)..(1243): Xaa can be any naturally occurring amino acid
  misc_feature (1245)..(1245): Xaa can be any naturally occurring amino acid
  misc_feature (1247)..(1247): Xaa can be any naturally occurring amino acid
  misc_feature (1249)..(1249): Xaa can be any naturally occurring amino acid
  misc_feature (1251)..(1251): Xaa can be any naturally occurring amino acid
  misc_feature (1253)..(1253): Xaa can be any naturally occurring amino acid
  misc_feature (1255)..(1255): Xaa can be any naturally occurring amino acid
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYLLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHXPXPXPXPXPXPXPXPXPXPXPXPXPXPMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 309 - protein, 1479 aa, Artificial Sequence
  SYNTHETIC
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYLLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHGGGGSEAAAKGGGGSMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 310 - protein, 1228 aa, Artificial Sequence
  SYNTHETIC
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYLLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 311 - protein, 1607 aa, Artificial Sequence
  SYNTHETIC
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 312 - protein, 1543 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 313 - protein, 1467 aa, Artificial Sequence
  SYNTHETIC
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 314 - protein, 1467 aa, Artificial Sequence
  SYNTHETIC
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYLLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 315 - protein, 1604 aa, Artificial Sequence
  SYNTHETIC
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 316 - protein, 1543 aa, Artificial Sequence; identical to SEQ ID NO: 312
  SYNTHETIC

SEQ ID NO: 317 - protein, 1464 aa, Artificial Sequence
  SYNTHETIC
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 318 - protein, 1464 aa, Artificial Sequence
  SYNTHETIC
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYLLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 319 - RNA, 36 nt, Artificial Sequence
  SYNTHETIC
uccauuucauagucuuuccuguuuuagagcuaugcu

SEQ ID NO: 320 - RNA, 36 nt, Artificial Sequence
  SYNTHETIC
uuuuguaauuaacagcuugcguuuuagagcuaugcu

SEQ ID NO: 321 - RNA, 36 nt, Artificial Sequence
  SYNTHETIC
cuuagagaauauuuguagagguuuuagagcuaugcu

SEQ ID NO: 322 - RNA, 36 nt, Artificial Sequence
  SYNTHETIC
uugacuauaaugaauacuucguuuuagagcuaugcu

SEQ ID NO: 323 - RNA, 36 nt, Artificial Sequence
  SYNTHETIC
caaaacacagcauaaaauuuguuuuagagcuaugcu

SEQ ID NO: 324 - RNA, 36 nt, Artificial Sequence
  SYNTHETIC
aauuauggggauuacuaggaguuuuagagcuaugcu

SEQ ID NO: 325 - RNA, 36 nt, Artificial Sequence
  SYNTHETIC
ggucacuuuuaacacacccaguuuuagagcuaugcu

SEQ ID NO: 326 - RNA, 36 nt, Artificial Sequence
  SYNTHETIC
cuuauauccaacacuucgugguuuuagagcuaugcu

SEQ ID NO: 327 - RNA, 36 nt, Artificial Sequence
  SYNTHETIC
ggcuuauauccaacacuucgguuuuagagcuaugcu

SEQ ID NO: 328 - RNA, 36 nt, Artificial Sequence
  SYNTHETIC
auuucacauaaaacucuuuuguuuuagagcuaugcu

SEQ ID NO: 329 - RNA, 36 nt, Artificial Sequence
  SYNTHETIC
ucaaauuaugaggugcuggaguuuuagagcuaugcu

SEQ ID NO: 330 - RNA, 36 nt, Artificial Sequence
  SYNTHETIC
uacagcuuuaugugacuaauguuuuagagcuaugcu

SEQ ID NO: 331 - DNA, 27 bp, Artificial Sequence
  SYNTHETIC
aagaatgttgtgataaaaggtgatgct

SEQ ID NO: 332 - DNA, 24 bp, Artificial Sequence
  SYNTHETIC
acacatccatgggacttctgcctc

SEQ ID NO: 333 - DNA, 21 bp, Artificial Sequence
  SYNTHETIC
acacacccaaggaaagactat

SEQ ID NO: 334 - DNA, 21 bp, Artificial Sequence
  SYNTHETIC
taatgccctgtagtctctctg

SEQ ID NO: 335 - DNA, 21 bp, Artificial Sequence
  SYNTHETIC
ggttaaagatggttaaatgat

SEQ ID NO: 336 - DNA, 21 bp, Artificial Sequence
  SYNTHETIC
ttgtaggatatgcccttgact

SEQ ID NO: 337 - DNA, 4251 bp, Artificial Sequence
  SYNTHETIC
atgggcagcagcgccccaaagaagaagcggaaggtcggtatccacggagtcccagcagccatggacaaaaagtactctattggcctggatatcgggaccaacagcgtcgggtgggctgttatcaccgacgagtataaagtaccttcgaaaaagttcaaagtgctgggcaacaccgatcgccattcaatcaaaaagaacttgattggtgcgctgttgtttgactccggggaaaccgccgaggcgactcgccttaaacgtacagcacgtcgccggtacactcggcgtaagaatcgcatttgctatttgcaggaaatctttagcaacgagatggcaaaagtcgatgactcgtttttccaccgcctcgaggaaagctttctggtggaggaagacaaaaagcatgagcgtcacccgatcttcggcaacattgtcgatgaagtagcgtatcatgaaaaatacccaaccatttaccacttacgcaaaaagctggtggacagcactgacaaagctgatttgcgccttatctatttagccctggcacatatgattaagtttcgtggtcacttcctgatcgaaggagacttaaatcccgacaacagtgatgttgataaattgtttattcagcttgtccaaacttacaatcaactgttcgaggaaaacccgatcaatgcctccggtgtggatgcaaaagccattttaagtgcacgccttagcaagtcccgtcgcttagaaaaccttatcgcgcagctgcccggcgagaaaaagaatggtttgtttgggaaccttattgccttgagcttaggcctcaccccgaatttcaaaagtaatttcgatcttgcagaagacgccaaattacaactgtcgaaggatacttatgatgacgatctcgataatctgttagcgcagattggtgaccaatacgccgatctttttctggcggctaaaaatctgagcgacgccatcttgctttcggatattctccgcgttaacaccgaaatcacgaaagcgcctcttagtgccagcatgattaaacgttatgatgaacaccaccaggacctgaccttactcaaagcgttggttcgccagcaactgccagagaagtacaaagaaatcttctttgatcagtcaaagaatggttatgccggctatattgacgggggtgcaagccaagaggaattctacaaatttatcaagcctattctggagaaaatggatggcaccgaagagttattggtgaagcttaaccgtgaagacctcctgcggaaacagcgcacattcgataatggttcgatcccacaccaaatccatttgggggagttacacgctattttgcgtcgccaggaagacttttaccctttcctgaaggataaccgggagaaaattgagaagatccttacctttcgtattccgtattacgtaggccccttagcacggggtaatagccgtttcgcgtggatgacacggaagtcggaagagacgatcaccccgtggaacttcgaagaggtagtcgacaagggcgcatcagcgcagtcttttattgaacgtatgacgaatttcgataaaaacttgcccaatgagaaggtgcttccgaaacattccttgttatatgaatattttacagtttacaacgagctgaccaaggttaaatacgtgacggaaggaatgcgcaagcccgcttttcttagcggtgagcaaaaaaaggcgatcgtcgacctgttattcaaaacgaatcgtaaggtgactgtaaagcaactcaaagaagattacttcaaaaagattgagtgcttcgacagcgtcgaaatctctggggtagaggatcggtttaacgcaagtttaggtacctaccatgacctgcttaaaatcattaaggataaagacttcttagataatgaagagaacgaagatattctcgaggacatcgtcttgacgttaaccttatttgaggatcgtgaaatgattgaggaacgcctcaaaacttatgcccacctgttcgacgataaggtgatgaagcagctgaaacgtcggcgctacacaggatggggccgcttgagtcgcaaacttattaacggaatccgtgacaagcaatccggcaaaacgattctggatttcttgaagtcggacggatttgctaatcgcaacttcatgcagttgatccatgatgactccctgacttttaaagaggatattcaaaaggcgcaggttagtggtcaaggcgacagcttacacgaacacatcgcaaatttggctggttcgccggccattaaaaaggggatcctccagaccgtgaaagttgtagatgagcttgttaaggtcatgggtcgtcataagcccgaaaacatcgtgattgaaatggcgcgggagaatcaaacgacccagaaaggacaaaagaatagccgtgaacggatgaagcggatcgaggaaggcattaaagagctggggtctcaaatcttgaaggaacaccctgtggagaacactcagctccaaaatgaaaaactttacctgtactatttgcagaacggacgcgatatgtacgtggaccaagagttggatattaatcggctgagtgactacgacgttgatcatatcgtcccgcagagcttcctcaaagacgattctattgacaataaggtactgacgcgctctgataaaaaccgtggtaagtcggacaacgtgccctccgaagaggttgtgaaaaagatgaaaaattattggcgccagcttttaaacgcgaagctgatcacacaacgtaaattcgataatttgaccaaggctgaacggggtggcctgagcgagttagataaggcaggatttattaaacgccagttagtggagactcgtcaaatcaccaaacatgtcgcgcagattttggacagccggatgaacaccaagtacgatgaaaatgacaaactgatccgtgaggtgaaagtcattactctgaagtccaaattagttagtgatttccggaaggactttcaattctacaaagtccgtgaaattaataactatcatcacgcacatgacgcgtacctgaatgcagtggttgggaccgcccttatcaagaaatatcctaagctggagtcggagtttgtctatggcgactataaggtatacgatgttcgcaaaatgattgcgaaatctgagcaggagatcggtaaggcaaccgcaaaatatttcttttactcaaacattatgaatttctttaagacagaaatcactctggccaacggggagattcgcaaacgtccgttgatcgaaacaaacggcgagactggcgaaattgtttgggacaaagggcgtgatttcgcgacggtgcgcaaggtactgagcatgcctcaagtcaatattgttaagaaaaccgaagtgcagacgggcgggttttccaaggaaagcatcttacccaaacgtaattcagataaacttattgcacgcaaaaaggactgggatccgaaaaagtatggaggcttcgacagtccaaccgtagcctactctgttctcgttgtagcgaaagtagaaaagggtaaatccaagaaactgaaatctgtcaaggagttgcttggaatcaccattatggagcgtagctccttcgagaagaacccgattgactttctggaagccaaaggatataaagaggtcaagaaagatcttatcattaagctgcctaagtattcactcttcgagctggaaaatggtcgtaaacgcatgctcgcttctgccggcgagttgcagaagggcaatgaattagcacttccatcaaagtacgttaacttcctgtatttggccagccattacgagaaactgaaggggtctccagaggacaacgaacagaaacaattatttgtagagcagcacaagcattatcttgatgaaatcattgagcaaatttccgaattcagtaaacgcgtaatcctggccgatgcaaacctcgacaaggtgctgagcgcttacaataagcatcgcgacaaacctatccgtgagcaggctgaaaatatcattcacctgttcacattaacgaacctgggcgctccggccgcttttaaatatttcgacacgacaatcgaccgtaagcgctataccagtacgaaagaagtgttggatgcgacccttattcaccagtcaattacaggattatatgagacccgtatcgaccttagccaattaggtggggatgcggccccgaagaaaaaacgcaaagtggatccgaagaaaaaacgcaaagtggcggccgcactcgagcaccaccaccaccaccactga

SEQ ID NO: 338 - DNA, 4290 bp, Artificial Sequence
  SYNTHETIC
atgggcaagcccatccctaaccccctgttggggctggacagcaccgctcccaaaaagaaaaggaaggtgggcattcacggcgtgcctgcggccgacaaaaagtacagcatcggccttgatatcggcaccaatagcgtgggctgggccgttatcacagacgaatacaaggtacccagcaagaagttcaaggtgctggggaatacagacaggcactctatcaagaaaaaccttatcggggctctgctgtttgactcaggcgagaccgccgaggccaccaggttgaagaggaccgcaaggcgaaggtacacccggaggaagaacaggatctgctatctgcaggagatcttcagcaacgagatggccaaggtggacgacagcttcttccacaggctggaggagagcttccttgtcgaggaggataagaagcacgaacgacaccccatcttcggcaacatagtcgacgaggtcgcttatcacgagaagtaccccaccatctaccacctgcgaaagaaattggtggatagcaccgataaagccgacttgcgacttatctacttggctctggcgcacatgattaagttcaggggccacttcctgatcgagggcgaccttaaccccgacaacagtgacgtagacaaattgttcatccagcttgtacagacctataaccagctgttcgaggaaaaccctattaacgccagcggggtggatgcgaaggccatacttagcgccaggctgagcaaaagcaggcgcttggagaacctgatagcccagctgcccggtgaaaagaagaacggcctcttcggtaatctgattgccctgagcctgggcctgacccccaacttcaagagcaacttcgacctggcagaagatgccaagctgcagttgagtaaggacacctatgacgacgacttggacaatctgctcgcccaaatcggcgaccagtacgctgacctgttcctcgccgccaagaacctttctgacgcaatcctgcttagcgatatccttagggtgaacacagagatcaccaaggcccccctgagcgccagcatgatcaagaggtacgacgagcaccatcaggacctgacccttctgaaggccctggtgaggcagcaactgcccgagaagtacaaggagatctttttcgaccagagcaagaacggctacgccggctacatcgacggcggagccagccaagaggagttctacaagttcatcaagcccatcctggagaagatggatggcaccgaggagctgctggtgaagctgaacagggaagatttgctccggaagcagaggacctttgacaacggtagcatcccccaccagatccacctgggcgagctgcacgcaatactgaggcgacaggaggatttctaccccttcctcaaggacaatagggagaaaatcgaaaagattctgaccttcaggatcccctactacgtgggccctcttgccaggggcaacagccgattcgcttggatgacaagaaagagcgaggagaccatcaccccctggaacttcgaggaagtggtggacaaaggagcaagcgcgcagtctttcatcgaacggatgaccaatttcgacaaaaacctgcctaacgagaaggtgctgcccaagcacagcctgctttacgagtacttcaccgtgtacaacgagctcaccaaggtgaaatatgtgaccgagggcatgcgaaaacccgctttcctgagcggcgagcagaagaaggccatcgtggacctgctgttcaagaccaacaggaaggtgaccgtgaagcagctgaaggaggactacttcaagaagatcgagtgctttgatagcgtggaaataagcggcgtggaggacaggttcaacgccagcctgggcacctaccacgacttgttgaagataatcaaagacaaggatttcctggataatgaggagaacgaggatatactcgaggacatcgtgctgactttgaccctgtttgaggaccgagagatgattgaagaaaggctcaaaacctacgcccacctgttcgacgacaaagtgatgaaacaactgaagagacgaagatacaccggctggggcagactgtccaggaagctcatcaacggcattagggacaagcagagcggcaagaccatcctggatttcctgaagtccgacggcttcgccaaccgaaacttcatgcagctgattcacgatgacagcttgaccttcaaggaggacatccagaaggcccaggttagcggccagggcgactccctgcacgaacatattgcaaacctggcaggctcccctgcgatcaagaagggcatactgcagaccgttaaggttgtggacgaattggtcaaggtcatgggcaggcacaagcccgaaaacatagttatagagatggccagagagaaccagaccacccaaaagggccagaagaacagccgggagcgcatgaaaaggatcgaggagggtatcaaggaactcggaagccagatcctcaaagagcaccccgtggagaatacccagctccagaacgagaagctgtacctgtactacctgcagaacggcagggacatgtacgttgaccaggagttggacatcaacaggctttcagactatgacgtggatcacatagtgccccagagctttcttaaagacgatagcatcgacaacaaggtcctgacccgctccgacaaaaacaggggcaaaagcgacaacgtgccaagcgaagaggtggttaaaaagatgaagaactactggaggcaactgctcaacgcgaaattgatcacccagagaaagttcgataacctgaccaaggccgagaggggcggactctccgaacttgacaaagcgggcttcataaagaggcagctggtcgagacccgacagatcacgaagcacgtggcccaaatcctcgacagcagaatgaataccaagtacgatgagaatgacaaactcatcagggaagtgaaagtgattaccctgaagagcaagttggtgtccgactttcgcaaagatttccagttctacaaggtgagggagatcaacaactaccaccatgcccacgacgcatacctgaacgccgtggtcggcaccgccctgattaagaagtatccaaagctggagtccgaatttgtctacggcgactacaaagtttacgatgtgaggaagatgatcgctaagagcgaacaggagatcggcaaggccaccgctaagtatttcttctacagcaacatcatgaactttttcaagaccgagatcacacttgccaacggcgaaatcaggaagaggccgcttatcgagaccaacggtgagaccggcgagatcgtgtgggacaagggcagggacttcgccaccgtgaggaaagtcctgagcatgccccaggtgaatattgtgaaaaaaactgaggtgcagacaggcggctttagcaaggaatccatcctgcccaagaggaacagcgacaagctgatcgcccggaagaaggactgggaccctaagaagtatggaggcttcgacagccccaccgtagcctacagcgtgctggtggtcgcgaaggtagagaaggggaagagcaagaaactgaagagcgtgaaggagctgctcggcataaccatcatggagaggtccagctttgagaagaaccccattgactttttggaagccaagggctacaaagaggtcaaaaaggacctgatcatcaaactccccaagtactccctgtttgaattggagaacggcagaaagaggatgctggcgagcgctggggaactgcaaaagggcaacgaactggcgctgcccagcaagtacgtgaattttctgtacctggcgtcccactacgaaaagctgaaaggcagccccgaggacaacgagcagaagcagctgttcgtggagcagcacaagcattacctggacgagataatcgagcaaatcagcgagttcagcaagagggtgattctggccgacgcgaacctggataaggtcctcagcgcctacaacaagcaccgagacaaacccatcagggagcaggccgagaatatcatacacctgttcaccctgacaaatctgggcgcacctgcggcattcaaatacttcgataccaccatcgacaggaaaaggtacactagcactaaggaggtgctggatgccaccttgatccaccagtccattaccggcctgtatgagaccaggatcgacctgagccagcttggaggcgactctagggcggacccaaaaaagaaaaggaaggtggaattccaccacactggactagtggatccgagctcggtaccaagcttaagtttaaaccgctga

SEQ ID NO: 339 - DNA, 3921 bp, Artificial Sequence
  SYNTHETIC
atgacccagtttgaaggtttcaccaatctgtatcaggttagcaaaaccctgcgttttgaactgattccgcagggtaaaaccctgaaacatattcaagaacagggcttcatcgaagaggataaagcacgtaacgatcactacaaagaactgaaaccgattatcgaccgcatctataaaacctatgcagatcagtgtctgcagctggttcagctggattgggaaaatctgagcgcagcaattgatagttatcgcaaagaaaaaaccgaagaaacccgtaatgcactgattgaagaacaggcaacctatcgtaatgccatccatgattatttcattggtcgtaccgataatctgaccgatgcaattaacaaacgtcacgccgaaatctataaaggcctgtttaaagccgaactgtttaatggcaaagttctgaaacagctgggcaccgttaccaccaccgaacatgaaaatgcactgctgcgtagctttgataaattcaccacctatttcagcggcttttatgagaatcgcaaaaacgtgtttagcgcagaagatattagcaccgcaattccgcatcgtattgtgcaggataatttcccgaaattcaaagagaactgccacatttttacccgtctgattaccgcagttccgagcctgcgtgaacattttgaaaacgttaaaaaagccatcggcatctttgttagcaccagcattgaagaagtttttagcttcccgttttacaatcagctgctgacccagacccagattgatctgtataaccaactgctgggtggtattagccgtgaagcaggcaccgaaaaaatcaaaggtctgaatgaagtgctgaatctggccattcagaaaaatgatgaaaccgcacatattattgcaagcctgccgcatcgttttattccgctgttcaaacaaattctgagcgatcgtaataccctgagctttattctggaagaattcaaatccgatgaagaggtgattcagagcttttgcaaatacaaaacgctgctgcgcaatgaaaatgttctggaaactgccgaagcactgtttaacgaactgaatagcattgatctgacccacatctttatcagccacaaaaaactggaaaccatttcaagcgcactgtgtgatcattgggataccctgcgtaatgccctgtatgaacgtcgtattagcgaactgaccggtaaaattaccaaaagcgcgaaagaaaaagttcagcgcagtctgaaacatgaggatattaatctgcaagagattattagcgcagccggtaaagaactgtcagaagcatttaaacagaaaaccagcgaaattctgtcacatgcacatgcagcactggatcagccgctgccgaccaccctgaaaaaacaagaagaaaaagaaatcctgaaaagccagctggatagcctgctgggtctgtatcatctgctggactggtttgcagttgatgaaagcaatgaagttgatccggaatttagcgcacgtctgaccggcattaaactggaaatggaaccgagcctgagcttttataacaaagcccgtaattatgccaccaaaaaaccgtatagcgtcgaaaaattcaaactgaactttcagatgccgaccctggcaagcggttgggatgttaataaagaaaaaaacaacggtgccatcctgttcgtgaaaaatggcctgtattatctgggtattatgccgaaacagaaaggtcgttataaagcgctgagctttgaaccgacggaaaaaaccagtgaaggttttgataaaatgtactacgactattttccggatgcagccaaaatgattccgaaatgtagcacccagctgaaagcagttaccgcacattttcagacccataccaccccgattctgctgagcaataactttattgaaccgctggaaatcaccaaagagatctacgatctgaataacccggaaaaagagccgaaaaaattccagaccgcatatgcaaaaaaaaccggtgatcagaaaggttatcgtgaagcgctgtgtaaatggattgatttcacccgtgattttctgagcaaatacaccaaaaccaccagtatcgatctgagcagcctgcgtccgagcagccagtataaagatctgggcgaatattatgcagaactgaatccgctgctgtatcatattagctttcagcgtattgccgagaaagaaatcatggacgcagttgaaaccggtaaactgtacctgttccagatctacaataaagattttgccaaaggccatcatggcaaaccgaatctgcataccctgtattggaccggtctgtttagccctgaaaatctggcaaaaacctcgattaaactgaatggtcaggcggaactgttttatcgtccgaaaagccgtatgaaacgtatggcacatcgtctgggtgaaaaaatgctgaacaaaaaactgaaagaccagaaaaccccgatcccggatacactgtatcaagaactgtatgattatgtgaaccatcgtctgagccatgatctgagtgatgaagcacgtgccctgctgccgaatgttattaccaaagaagttagccacgagatcattaaagatcgtcgttttaccagcgacaaattcttttttcatgtgccgattaccctgaattatcaggcagcaaatagcccgagcaaatttaaccagcgtgttaatgcatatctgaaagaacatccagaaacgccgattattggtattgatcgtggtgaacgtaacctgatttatatcaccgttattgatagcaccggcaaaatcctggaacagcgtagcctgaataccattcagcagtttgattaccagaaaaaactggataatcgcgagaaagaacgtgttgcagcacgtcaggcatggtcagttgttggtacaattaaagacctgaaacagggttatctgagccaggttattcatgaaattgtggatctgatgattcactatcaggccgttgttgtgctggaaaacctgaattttggctttaaaagcaaacgtaccggcattgcagaaaaagcagtttatcagcagttcgagaaaatgctgattgacaaactgaattgcctggtgctgaaagattatccggctgaaaaagttggtggtgttctgaatccgtatcagctgaccgatcagtttaccagctttgcaaaaatgggcacccagagcggatttctgttttatgttccggcaccgtatacgagcaaaattgatccgctgaccggttttgttgatccgtttgtttggaaaaccatcaaaaaccatgaaagccgcaaacattttctggaaggtttcgattttctgcattacgacgttaaaacgggtgatttcatcctgcactttaaaatgaatcgcaatctgagttttcagcgtggcctgcctggttttatgcctgcatgggatattgtgtttgagaaaaacgaaacacagttcgatgcaaaaggcaccccgtttattgcaggtaaacgtattgttccggtgattgaaaatcatcgtttcaccggtcgttatcgcgatctgtatccggcaaatgaactgatcgcactgctggaagagaaaggtattgtttttcgtgatggctcaaacattctgccgaaactgctggaaaatgatgatagccatgcaattgataccatggttgcactgattcgtagcgttctgcagatgcgtaatagcaatgcagcaaccggtgaagattacattaatagtccggttcgtgatctgaatggtgtttgttttgatagccgttttcagaatccggaatggccgatggatgcagatgcaaatggtgcatatcatattgcactgaaaggacagctgctgctgaaccacctgaaagaaagcaaagatctgaaactgcaaaacggcattagcaatcaggattggctggcatatatccaagaactgcgtaac

SEQ ID NO: 340 - DNA, 3921 bp, Artificial Sequence; identical to SEQ ID NO: 339
  SYNTHETIC

SEQ ID NO: 341 - DNA, 3684 bp, Artificial Sequence
  SYNTHETIC
atgagtaagctggagaaatttactaattgttactcactgtcaaaaacgctgcgtttcaaagcgatcccagtgggcaaaactcaagaaaatattgacaataaacgtttgcttgtcgaagacgaaaagcgcgccgaagactataagggggtgaagaagcttcttgaccgttactacctttcattcatcaacgatgttctgcacagcatcaagttaaaaaaccttaacaattacattagtttgtttcgcaagaagacacgtacagagaaagagaataaagagcttgaaaacttagagattaaccttcgcaaggagatcgcaaaggcgttcaaaggcaatgaaggctataagtcgttatttaaaaaagacatcattgaaacgattctgcccgagtttttggatgataaggatgaaatcgccttagttaattcgttcaatgggttcactacagcctttacaggattctttgataaccgtgaaaacatgtttagcgaggaagcaaaaagcacgagcattgcatttcgctgcattaacgaaaatttgactcgttatatctctaacatggacatctttgagaaggttgacgcgatcttcgataagcacgaagtccaggagatcaaggagaagattctgaacagcgattacgacgttgaagactttttcgagggggaattttttaactttgtgcttacgcaggaaggaatcgatgtatataatgcaattattggtggcttcgtgacagagtcaggtgagaagattaaaggattaaatgaatatatcaatttatacaatcagaagaccaagcagaagcttcccaagttcaagccactgtacaagcaagtgttgtccgaccgcgagagcctttccttttacggtgaaggctataccagtgacgaagaggtgttagaagtcttccgtaacacgttaaacaaaaattccgaaattttctcatccatcaaaaagctggagaaattatttaagaacttcgacgaatacagtagtgcagggatttttgtgaaaaatggaccagctatcagtactatttctaaagacatcttcggggaatggaatgtgattcgcgataagtggaatgctgagtatgatgatattcatctgaagaagaaggctgtcgtaacggagaagtatgaggacgatcgccgtaagtcattcaaaaaaattggctccttcagccttgagcagctgcaggagtatgctgatgctgatctgtcggttgtcgagaagttaaaagagattattatccaaaaggtagacgaaatttataaggtctacgggagtagcgaaaagttgtttgatgctgacttcgttttagaaaaaagtttgaagaagaatgatgcggtcgttgccattatgaaagatttgctggatagtgttaaatctttcgagaattacatcaaagccttttttggtgaagggaaagagactaatcgcgacgagtctttctacggagattttgtgttagcgtacgatatcctgttgaaggtagaccacatctatgacgctattcgcaattatgtcacacaaaaaccatattctaaggacaagttcaaattgtactttcagaacccccaattcatgggcggatgggacaaggataaggaaacagactaccgtgcgacgattttgcgctacggtagcaaatactacctggctatcatggacaaaaagtacgcaaaatgtttacagaaaattgacaaggatgacgtcaacggtaactatgaaaaaatcaattacaaattactgcctgggccaaataagatgctgccaaaagtgttctttagtaagaaatggatggcctactataatccgtctgaggacatccaaaaaatctacaaaaacggcacgttcaagaagggagatatgttcaatttaaacgattgtcacaaattaatcgatttttttaaagattccatttcccgttatccaaagtggtccaatgcatatgacttcaactttagcgagaccgagaaatacaaggatatcgccggattctatcgtgaggtggaggaacaaggttacaaggtctcctttgagtcagcctctaaaaaggaggttgataaattggtggaggagggcaaattgtatatgttccaaatttacaacaaagacttctctgacaagagtcatggcactcctaacttgcacactatgtatttcaaattgttatttgatgaaaataatcatggtcaaatccgtttgtcaggcggtgcagaattgttcatgcgtcgcgctagcttaaagaaggaggagttagtagtacacccggctaacagtccgatcgctaacaaaaacccggacaatcccaaaaaaacaactacgctgagttacgacgtgtataaagataaacgcttctcagaggaccaatatgaactgcatatccccatcgccatcaataagtgccccaagaacattttcaagatcaatacggaagtacgcgtcctgttgaagcacgatgataacccgtacgtcattggtatcgaccgcggtgaacgcaatttactttatatcgtcgtagtggacggtaaaggcaacattgtagagcaatattccttaaacgagatcatcaataattttaacggcatccgcattaaaacagattaccactctctgctggataaaaaagagaaagagcgtttcgaagctcgtcagaattggacctccatcgagaatatcaaagagcttaaagcggggtacatttcacaggtggtgcataagatttgcgagttggtagaaaaatacgacgccgtaatcgcattggaggatctgaattcgggtttcaaaaacagccgtgttaaggttgaaaaacaagtctatcaaaaattcgaaaagatgttaattgacaaattgaactatatggttgataaaaagtcgaatccatgtgcgacagggggggcattaaagggatatcagattactaataaattcgaatcgttcaagagcatgagcactcaaaatggcttcatcttttacatcccagcatggctgacctcgaaaattgatccttccacaggtttcgtcaaccttttgaagactaagtatactagtattgcggactcgaagaagttcatcagttctttcgaccgtattatgtatgtgccggaggaggatctgtttgagttcgcattggattataagaatttcagccgcaccgacgcggactacattaaaaaatggaaattatactcatacggaaatcgcattcgtatctttcgtaatcccaaaaagaacaatgttttcgactgggaggaagtgtgccttacttcggcgtataaggagcttttcaacaaatacggaattaactaccagcagggcgatattcgcgccctgttatgtgaacaatctgataaagcgttttacagctcctttatggcattaatgtccttaatgttgcagatgcgcaactcgatcacgggtcgtacagacgttgatttcttaatctcaccggttaagaacagtgacggcatcttctacgactctcgcaactacgaggcacaggagaatgccatcttacccaagaacgcagatgcaaatggtgcgtacaatatcgctcgtaaagtcctttgggcaatcggccaattcaagaaggctgaagacgagaagctggacaaggtgaaaatcgcgatttctaataaggaatggctggagtatgcgcagacgagtgtaaagcac

SEQ ID NO: 342 - DNA, 3684 bp, Artificial Sequence
  SYNTHETIC
atgtctaaactggagaaattcactaattgctactccttgtcaaaaacattgcgatttaaagctatacccgttggtaagactcaggaaaacatcgacaacaaacggcttctggtagaggacgaaaaacgcgccgaggattataaaggagtaaaaaaactgttggacaggtactacctgagtttcatcaatgacgtgctgcatagtattaaactgaaaaacctcaacaattacatctctctgtttagaaaaaagacacggacggaaaaggagaataaagaattggagaatcttgagataaacctgcgcaaggaaatagccaaggcattcaaaggaaacgaaggctacaagtccttgtttaaaaaggatattatcgagaccatacttcccgagtttttggacgacaaagacgaaatcgctctggtgaactcttttaatggctttactacagcctttacaggattttttgacaacagagagaatatgttctctgaggaggcaaagtctaccagcattgccttccgatgtataaacgaaaacctgacaagatatatatcaaacatggacatttttgaaaaagttgatgcgatatttgacaaacacgaggtccaagagataaaggaaaaaatcctgaactcagattacgacgtggaagatttttttgagggtgagtttttcaatttcgttcttacgcaggaggggatcgacgtatataacgctatcattgggggcttcgttaccgaatctggagaaaagatcaaaggccttaacgagtatataaatctgtacaatcagaaaacgaagcaaaagctcccaaagttcaagcccctttataaacaggtccttagtgaccgggaaagcctctctttctatggagaagggtacacctccgatgaagaggttctggaggtgttccgaaatactctcaataaaaactctgaaattttcagcagcatcaaaaaattggagaagctctttaaaaatttcgacgaatattcctctgctggaatatttgtgaagaacggacccgcaatctctaccataagcaaggatatctttggtgaatggaatgtaattagagataaatggaatgcggagtacgatgacatccacctcaaaaaaaaggctgtcgtaacggagaaatacgaagatgaccgcagaaagagtttcaaaaaaatcggttctttttcactggaacagctccaggaatacgcggatgccgacttgagcgttgtagaaaaactgaaagaaataattatccagaaagtagatgagatttacaaagtgtatgggagcagcgaaaaactttttgatgcagattttgtacttgaaaaaagtcttaaaaaaaatgatgcagttgtcgccattatgaaagatctcctcgacagtgtaaaatcttttgagaattacatcaaggctttttttggcgagggcaaggagacgaatagggatgaaagtttttatggtgactttgtacttgcttacgacatcctgctcaaggtcgatcatatttacgatgctatacgcaattacgtgacacagaaaccgtactctaaagataagtttaagttgtatttccagaatcctcagttcatgggtggctgggacaaggataaggagacagattatcgagcgactattttgcgctatggctctaagtattacctcgctataatggacaaaaagtacgctaaatgcctgcagaaaattgataaggacgacgtgaacggtaactatgagaaaattaactataagttgttgcccggccctaataagatgctgccgaaagtctttttctccaaaaagtggatggcgtactacaatccatcagaagatatccagaagatatacaagaatggcacctttaagaaaggagatatgtttaaccttaacgactgtcacaagttgattgacttctttaaggatagcatttctcgatacccaaagtggtctaatgcatatgatttcaatttctctgagacggagaagtataaagacattgcggggttctaccgagaagtcgaagaacaagggtacaaggtaagttttgaatctgcttcaaaaaaagaggtagacaaactggtagaagagggaaaactctacatgttccagatctataataaggacttctctgacaaaagtcacggtactccgaacctccatacgatgtacttcaagctgctttttgatgaaaacaatcatggccagatacgcctcagtggaggagcggaattgtttatgcgccgcgcctccctgaagaaagaagagctggtagtacatcctgccaattccccaatcgcaaacaaaaatccggataatcctaaaaagaccactacgttgagctacgacgtttacaaggataagagattttccgaggatcagtacgagcttcatatccctatcgccataaataagtgcccaaagaatattttcaaaataaacacggaagtaagagtactgctcaagcatgatgataatccctacgtaattggaattgataggggggaacggaacttgctttatatagtcgtcgtcgatggcaaagggaacattgttgaacaatactctctgaatgagatcatcaacaacttcaacggtatccgcattaaaactgattatcattctctcctggacaaaaaagaaaaggaaaggttcgaagcgcgccagaactggacttcaattgaaaacattaaggagctcaaagctggctatatatctcaggttgtccataagatatgcgaactggtagaaaaatatgatgccgtcattgctctcgaggacctgaacagcggttttaagaacagccgggtcaaagtcgaaaagcaggtctatcaaaagttcgagaagatgctcatagacaaactcaactatatggtcgataagaagtctaacccgtgtgctacgggaggggcactgaagggataccagatcacgaataagtttgaatcattcaaaagcatgagtacccaaaatggatttattttctacattcccgcgtggttgacctcaaaaatcgaccctagtacaggattcgtgaacctgctgaagactaagtacactagtattgcggatagcaagaaatttataagctcttttgaccgcattatgtacgtacccgaagaagatttgtttgagttcgctctcgactacaaaaattttagcagaaccgacgccgattacataaagaagtggaaactctactcttatgggaaccgcatacgcatattccgaaaccctaaaaaaaacaatgtattcgattgggaagaggtttgcctgaccagcgcgtacaaagagctttttaacaagtatggtataaattatcagcagggtgacatccgcgccttgttgtgtgagcaaagtgacaaggcgttctacagttcatttatggcgttgatgtccctcatgttgcagatgcgaaattccatcacggggaggacagatgtagatttcctcatctctccggtcaagaacagtgatggcatcttttacgacagccggaattacgaggcgcaggagaatgccatactccctaagaatgcggacgcgaacggagcatataacatcgcgcgaaaagtcctgtgggctattggtcaattcaaaaaggctgaagatgagaagttggacaaggtgaagatagccattagtaacaaggaatggttggagtacgctcagacatcagtgaaacat

SEQ ID NO: 343 - DNA, 717 bp, Artificial Sequence
  SYNTHETIC
atggtaagtaaaggtgaagagctttttacaggtgtggtgcccatccttgtggagttggacggtgatgtcaatggccataaattttctgtgtctggtgaaggggaaggggacgcgacgtatggaaaacttaccctgaagtttatctgcacgacaggtaagttgccagtaccgtggcctaccctggtcaccacattaacatatggtgttcaatgcttttcacgctaccctgaccacatgaaacaacatgacttttttaaaagtgccatgccagagggctacgtgcaggaacgcacaatctttttcaaagacgacggcaattataaaacacgcgcggaggtaaagtttgagggagacacactggttaatcgcatcgaactgaaaggcattgactttaaggaggatgggaatatcttaggccataaactggagtataactataactctcacaacgtctatattatggcggacaagcaaaagaatggtatcaaggtaaactttaagattcgtcataacattgaggatgggagcgtgcagttggctgaccactatcagcagaatactcccattggcgacggccccgtgcttttacctgacaatcactatctttctacgcagtcagctttgtccaaagaccccaacgagaagcgtgatcacatggttcttctggaattcgtcacagccgccggaatcactttaggcatggacgaactttataaa

SEQ ID NO: 344 - DNA, 717 bp, Artificial Sequence
  SYNTHETIC
atggtctcaaaaggcgaagaattgttcaccggtgtagtccctatcttggtggagcttgacggcgatgttaatggccataaatttagtgtgtccggcgaaggtgagggcgacgccacatatggtaaacttacgcttaaatttatttgcacgacgggaaagctccccgtgccgtggccaacccttgtaactacccttacgtacggggtgcagtgcttcagtaggtatcccgaccatatgaagcagcacgattttttcaaaagtgctatgcccgaggggtatgtgcaagagaggactatattctttaaggatgatgggaattacaagacgcgagccgaggttaagttcgaaggtgatacgcttgtaaatcgaatcgaattgaaagggattgactttaaggaagacggaaatatacttggacacaaattggaatataactacaacagccacaacgtctatataatggccgacaagcaaaagaacggaataaaagtcaactttaagattcgacacaatatagaggatggatccgtgcagcttgctgaccactatcagcagaacactccgataggcgatggaccagtgctgcttcccgacaatcactacctctccacgcagtctgctctgtctaaagaccctaatgaaaaacgagaccacatggtgctgctcgaatttgtcactgccgccgggattaccttgggaatggacgaactgtataag

SEQ ID NO: 345 - DNA, 708 bp, Artificial Sequence
  SYNTHETIC
atggtgtccaaaggagaagaggataacatggcgatcatcaaggaatttatgcgtttcaaagttcacatggagggaagcgtaaacggccatgaatttgagattgagggggaaggcgaaggccgtccatacgaaggcactcaaaccgccaagcttaaggttaccaagggaggtccgcttcctttcgcctgggatatccttagcccacagttcatgtatggctctaaagcatacgtcaagcaccctgcagacattcctgattatttgaaacttagttttcctgagggttttaagtgggaacgcgttatgaatttcgaggatggaggagtagtgacagtaactcaagattccagtcttcaagacggagagtttatctacaaggtgaaattacgtggcacgaactttccatccgacgggccagtgatgcagaagaaaaccatgggttgggaggcatcttctgagcgtatgtacccggaagacggggcgttgaaaggcgaaatcaagcagcgcctgaagttgaaagacgggggtcactacgatgcggaagtaaaaactacatataaggccaagaagcccgtccagcttccgggcgcgtacaacgtcaacatcaaattggacattacttcccacaacgaggattacactattgttgaacaatatgagcgtgcggagggacgccattcaaccggggggatggatgagctttacaag

SEQ ID NO: 346 - DNA, 708 bp, Artificial Sequence
  SYNTHETIC
atggtcagtaagggggaagaggacaacatggcgataatcaaggaatttatgagatttaaggtccatatggaaggctctgtcaacggtcatgagttcgaaattgagggggagggggaaggccgcccatatgaggggactcaaacagccaaacttaaggtcacaaaaggaggtcctctgcccttcgcgtgggacatactcagcccacaattcatgtatggaagtaaggcatatgttaaacacccggcggacatacccgactacctcaaactgtcatttcctgagggttttaagtgggagagggttatgaatttcgaggacggtggagtagtaacagtgacacaagactcttctctccaggatggagaatttatatacaaagtgaaactgcggggcactaactttccgtcagacggcccagtaatgcaaaagaaaactatggggtgggaggcttccagcgagcgcatgtatcccgaggatggggcccttaagggagaaataaaacaacgcttgaagctcaaagacggagggcactatgatgcggaggtcaaaacgacctacaaagcaaaaaagccagtacagcttccgggagcttataacgtgaatataaagctcgatataacctcacacaacgaggactacacgattgtagaacaatacgaaagagccgaggggagacatagtacggggggcatggacgaactttacaag

SEQ ID NO: 347 - DNA, 4104 bp, Artificial Sequence
  SYNTHETIC
atggacaaaaagtactctattggcctggatatcgggaccaacagcgtcgggtgggctgttatcaccgacgagtataaagtaccttcgaaaaagttcaaagtgctgggcaacaccgatcgccattcaatcaaaaagaacttgattggtgcgctgttgtttgactccggggaaaccgccgaggcgactcgccttaaacgtacagcacgtcgccggtacactcggcgtaagaatcgcatttgctatttgcaggaaatctttagcaacgagatggcaaaagtcgatgactcgtttttccaccgcctcgaggaaagctttctggtggaggaagacaaaaagcatgagcgtcacccgatcttcggcaacattgtcgatgaagtagcgtatcatgaaaaatacccaaccatttaccacttacgcaaaaagctggtggacagcactgacaaagctgatttgcgccttatctatttagccctggcacatatgattaagtttcgtggtcacttcctgatcgaaggagacttaaatcccgacaacagtgatgttgataaattgtttattcagcttgtccaaacttacaatcaactgttcgaggaaaacccgatcaatgcctccggtgtggatgcaaaagccattttaagtgcacgccttagcaagtcccgtcgcttagaaaaccttatcgcgcagctgcccggcgagaaaaagaatggtttgtttgggaaccttattgccttgagcttaggcctcaccccgaatttcaaaagtaatttcgatcttgcagaagacgccaaattacaactgtcgaaggatacttatgatgacgatctcgataatctgttagcgcagattggtgaccaatacgccgatctttttctggcggctaaaaatctgagcgacgccatcttgctttcggatattctccgcgttaacaccgaaatcacgaaagcgcctcttagtgccagcatgattaaacgttatgatgaacaccaccaggacctgaccttactcaaagcgttggttcgccagcaactgccagagaagtacaaagaaatcttctttgatcagtcaaagaatggttatgccggctatattgacgggggtgcaagccaagaggaattctacaaatttatcaagcctattctggagaaaatggatggcaccgaagagttattggtgaagcttaaccgtgaagacctcctgcggaaacagcgcacattcgataatggttcgatcccacaccaaatccatttgggggagttacacgctattttgcgtcgccaggaagacttttaccctttcctgaaggataaccgggagaaaattgagaagatccttacctttcgtattccgtattacgtaggccccttagcacggggtaatagccgtttcgcgtggatgacacggaagtcggaagagacgatcaccccgtggaacttcgaagaggtagtcgacaagggcgcatcagcgcagtcttttattgaacgtatgacgaatttcgataaaaacttgcccaatgagaaggtgcttccgaaacattccttgttatatgaatattttacagtttacaacgagctgaccaaggttaaatacgtgacggaaggaatgcgcaagcccgcttttcttagcggtgagcaaaaaaaggcgatcgtcgacctgttattcaaaacgaatcgtaaggtgactgtaaagcaactcaaagaagattacttcaaaaagattgagtgcttcgacagcgtcgaaatctctggggtagaggatcggtttaacgcaagtttaggtacctaccatgacctgcttaaaatcattaaggataaagacttcttagataatgaagagaacgaagatattctcgaggacatcgtcttgacgttaaccttatttgaggatcgtgaaatgattgaggaacgcctcaaaacttatgcccacctgttcgacgataaggtgatgaagcagctgaaacgtcggcgctacacaggatggggccgcttgagtcgcaaacttattaacggaatccgtgacaagcaatccggcaaaacgattctggatttcttgaagtcggacggatttgctaatcgcaacttcatgcagttgatccatgatgactccctgacttttaaagaggatattcaaaaggcgcaggttagtggtcaaggcgacagcttacacgaacacatcgcaaatttggctggttcgccggccattaaaaaggggatcctccagaccgtgaaagttgtagatgagcttgttaaggtcatgggtcgtcataagcccgaaaacatcgtgattgaaatggcgcgggagaatcaaacgacccagaaaggacaaaagaatagccgtgaacggatgaagcggatcgaggaaggcattaaagagctggggtctcaaatcttgaaggaacaccctgtggagaacactcagctccaaaatgaaaaactttacctgtactatttgcagaacggacgcgatatgtacgtggaccaagagttggatattaatcggctgagtgactacgacgttgatcatatcgtcccgcagagcttcctcaaagacgattctattgacaataaggtactgacgcgctctgataaaaaccgtggtaagtcggacaacgtgccctccgaagaggttgtgaaaaagatgaaaaattattggcgccagcttttaaacgcgaagctgatcacacaacgtaaattcgataatttgaccaaggctgaacggggtggcctgagcgagttagataaggcaggatttattaaacgccagttagtggagactcgtcaaatcaccaaacatgtcgcgcagattttggacagccggatgaacaccaagtacgatgaaaatgacaaactgatccgtgaggtgaaagtcattactctgaagtccaaattagttagtgatttccggaaggactttcaattctacaaagtccgtgaaattaataactatcatcacgcacatgacgcgtacctgaatgcagtggttgggaccgcccttatcaagaaatatcctaagctggagtcggagtttgtctatggcgactataaggtatacgatgttcgcaaaatgattgcgaaatctgagcaggagatcggtaaggcaaccgcaaaatatttcttttactcaaacattatgaatttctttaagacagaaatcactctggccaacggggagattcgcaaacgtccgttgatcgaaacaaacggcgagactggcgaaattgtttgggacaaagggcgtgatttcgcgacggtgcgcaaggtactgagcatgcctcaagtcaatattgttaagaaaaccgaagtgcagacgggcgggttttccaaggaaagcatcttacccaaacgtaattcagataaacttattgcacgcaaaaaggactgggatccgaaaaagtatggaggcttcgacagtccaaccgtagcctactctgttctcgttgtagcgaaagtagaaaagggtaaatccaagaaactgaaatctgtcaaggagttgcttggaatcaccattatggagcgtagctccttcgagaagaacccgattgactttctggaagccaaaggatataaagaggtcaagaaagatcttatcattaagctgcctaagtattcactcttcgagctggaaaatggtcgtaaacgcatgctcgcttctgccggcgagttgcagaagggcaatgaattagcacttccatcaaagtacgttaacttcctgtatttggccagccattacgagaaactgaaggggtctccagaggacaacgaacagaaacaattatttgtagagcagcacaagcattatcttgatgaaatcattgagcaaatttccgaattcagtaaacgcgtaatcctggccgatgcaaacctcgacaaggtgctgagcgcttacaataagcatcgcgacaaacctatccgtgagcaggctgaaaatatcattcacctgttcacattaacgaacctgggcgctccggccgcttttaaatatttcgacacgacaatcgaccgtaagcgctataccagtacgaaagaagtgttggatgcgacccttattcaccagtcaattacaggattatatgagacccgtatcgaccttagccaattaggtggggat

SEQ ID NO: 348 - DNA, 4857 bp, Artificial Sequence
  SYNTHETIC
atggacaaaaagtactctattggcctggatatcgggaccaacagcgtcgggtgggctgttatcaccgacgagtataaagtaccttcgaaaaagttcaaagtgctgggcaacaccgatcgccattcaatcaaaaagaacttgattggtgcgctgttgtttgactccggggaaaccgccgaggcgactcgccttaaacgtacagcacgtcgccggtacactcggcgtaagaatcgcatttgctatttgcaggaaatctttagcaacgagatggcaaaagtcgatgactcgtttttccaccgcctcgaggaaagctttctggtggaggaagacaaaaagcatgagcgtcacccgatcttcggcaacattgtcgatgaagtagcgtatcatgaaaaatacccaaccatttaccacttacgcaaaaagctggtggacagcactgacaaagctgatttgcgccttatctatttagccctggcacatatgattaagtttcgtggtcacttcctgatcgaaggagacttaaatcccgacaacagtgatgttgataaattgtttattcagcttgtccaaacttacaatcaactgttcgaggaaaacccgatcaatgcctccggtgtggatgcaaaagccattttaagtgcacgccttagcaagtcccgtcgcttagaaaaccttatcgcgcagctgcccggcgagaaaaagaatggtttgtttgggaaccttattgccttgagcttaggcctcaccccgaatttcaaaagtaatttcgatcttgcagaagacgccaaattacaactgtcgaaggatacttatgatgacgatctcgataatctgttagcgcagattggtgaccaatacgccgatctttttctggcggctaaaaatctgagcgacgccatcttgctttcggatattctccgcgttaacaccgaaatcacgaaagcgcctcttagtgccagcatgattaaacgttatgatgaacaccaccaggacctgaccttactcaaagcgttggttcgccagcaactgccagagaagtacaaagaaatcttctttgatcagtcaaagaatggttatgccggctatattgacgggggtgcaagccaagaggaattctacaaatttatcaagcctattctggagaaaatggatggcaccgaagagttattggtgaagcttaaccgtgaagacctcctgcggaaacagcgcacattcgataatggttcgatcccacaccaaatccatttgggggagttacacgctattttgcgtcgccaggaagacttttaccctttcctgaaggataaccgggagaaaattgagaagatccttacctttcgtattccgtattacgtaggccccttagcacggggtaatagccgtttcgcgtggatgacacggaagtcggaagagacgatcaccccgtggaacttcgaagaggtagtcgacaagggcgcatcagcgcagtcttttattgaacgtatgacgaatttcgataaaaacttgcccaatgagaaggtgcttccgaaacattccttgttatatgaatattttacagtttacaacgagctgaccaaggttaaatacgtgacggaaggaatgcgcaagcccgcttttcttagcggtgagcaaaaaaaggcgatcgtcgacctgttattcaaaacgaatcgtaaggtgactgtaaagcaactcaaagaagattacttcaaaaagattgagtgcttcgacagcgtcgaaatctctggggtagaggatcggtttaacgcaagtttaggtacctaccatgacctgcttaaaatcattaaggataaagacttcttagataatgaagagaacgaagatattctcgaggacatcgtcttgacgttaaccttatttgaggatcgtgaaatgattgaggaacgcctcaaaacttatgcccacctgttcgacgataaggtgatgaagcagctgaaacgtcggcgctacacaggatggggccgcttgagtcgcaaacttattaacggaatccgtgacaagcaatccggcaaaacgattctggatttcttgaagtcggacggatttgctaatcgcaacttcatgcagttgatccatgatgactccctgacttttaaagaggatattcaaaaggcgcaggttagtggtcaaggcgacagcttacacgaacacatcgcaaatttggctggttcgccggccattaaaaaggggatcctccagaccgtgaaagttgtagatgagcttgttaaggtcatgggtcgtcataagcccgaaaacatcgtgattgaaatggcgcgggagaatcaaacgacccagaaaggacaaaagaatagccgtgaacggatgaagcggatcgaggaaggcattaaagagctggggtctcaaatcttgaaggaacaccctgtggagaacactcagctccaaaatgaaaaactttacctgtactatttgcagaacggacgcgatatgtacgtggaccaagagttggatattaatcggctgagtgactacgacgttgatcatatcgtcccgcagagcttcctcaaagacgattctattgacaataaggtactgacgcgctctgataaaaaccgtggtaagtcggacaacgtgccctccgaagaggttgtgaaaaagatgaaaaattattggcgccagcttttaaacgcgaagctgatcacacaacgtaaattcgataatttgaccaaggctgaacggggtggcctgagcgagttagataaggcaggatttattaaacgccagttagtggagactcgtcaaatcaccaaacatgtcgcgcagattttggacagccggatgaacaccaagtacgatgaaaatgacaaactgatccgtgaggtgaaagtcattactctgaagtccaaattagttagtgatttccggaaggactttcaattctacaaagtccgtgaaattaataactatcatcacgcacatgacgcgtacctgaatgcagtggttgggaccgcccttatcaagaaatatcctaagctggagtcggagtttgtctatggcgactataaggtatacgatgttcgcaaaatgattgcgaaatctgagcaggagatcggtaaggcaaccgcaaaatatttcttttactcaaacattatgaatttctttaagacagaaatcactctggccaacggggagattcgcaaacgtccgttgatcgaaacaaacggcgagactggcgaaattgtttgggacaaagggcgtgatttcgcgacggtgcgcaaggtactgagcatgcctcaagtcaatattgttaagaaaaccgaagtgcagacgggcgggttttccaaggaaagcatcttacccaaacgtaattcagataaacttattgcacgcaaaaaggactgggatccgaaaaagtatggaggcttcgacagtccaaccgtagcctactctgttctcgttgtagcgaaagtagaaaagggtaaatccaagaaactgaaatctgtcaaggagttgcttggaatcaccattatggagcgtagctccttcgagaagaacccgattgactttctggaagccaaaggatataaagaggtcaagaaagatcttatcattaagctgcctaagtattcactcttcgagctggaaaatggtcgtaaacgcatgctcgcttctgccggcgagttgcagaagggcaatgaattagcacttccatcaaagtacgttaacttcctgtatttggccagccattacgagaaactgaaggggtctccagaggacaacgaacagaaacaattatttgtagagcagcacaagcattatcttgatgaaatcattgagcaaatttccgaattcagtaaacgcgtaatcctggccgatgcaaacctcgacaaggtgctgagcgcttacaataagcatcgcgacaaacctatccgtgagcaggctgaaaatatcattcacctgttcacattaacgaacctgggcgctccggccgcttttaaatatttcgacacgacaatcgaccgtaagcgctataccagtacgaaagaagtgttggatgcgacccttattcaccagtcaattacaggattatatgagacccgtatcgaccttagccaattaggtggggatggtagcgcaggtagtgcagcaggtagcggtgaatttatggttagcaaaggtgaagaactgtttaccggcgttgtgccgattctggtggaactggatggtgatgtgaatggccataaatttagcgttagcggcgaaggcgaaggtgatgcgacctatggtaaactgaccctgaaatttatttgcaccaccggtaaactgccggttccgtggccgaccctggtgaccaccctgacctatggcgttcagtgctttagccgctatccggatcatatgaaacagcatgatttctttaaaagcgcgatgccggaaggctatgtgcaggaacgtaccatttttttcaaagatgatggcaactataaaacccgtgcggaagttaaatttgaaggcgataccctggtgaaccgcattgaactgaaaggtattgattttaaagaagatggcaacattctgggtcataaactggaatataattacaacagccataatgtgtatattatggccgataaacagaaaaatggcatcaaagtgaactttaaaatccgtcacaacattgaagatggtagcgtgcagctggcggatcattatcagcagaataccccgattggtgatggcccggtgctgctgccggataatcattatctgagcacccagagcgcgctgagcaaagatccgaatgaaaaacgtgatcatatggtgctgctggaatttgttaccgccgcgggcattaccctgggtatggatgaactgtataaa

SEQ ID NO: 349 - DNA, 4881 bp, Artificial Sequence
  SYNTHETIC
atggacaaaaagtactctattggcctggatatcgggaccaacagcgtcgggtgggctgttatcaccgacgagtataaagtaccttcgaaaaagttcaaagtgctgggcaacaccgatcgccattcaatcaaaaagaacttgattggtgcgctgttgtttgactccggggaaaccgccgaggcgactcgccttaaacgtacagcacgtcgccggtacactcggcgtaagaatcgcatttgctatttgcaggaaatctttagcaacgagatggcaaaagtcgatgactcgtttttccaccgcctcgaggaaagctttctggtggaggaagacaaaaagcatgagcgtcacccgatcttcggcaacattgtcgatgaagtagcgtatcatgaaaaatacccaaccatttaccacttacgcaaaaagctggtggacagcactgacaaagctgatttgcgccttatctatttagccctggcacatatgattaagtttcgtggtcacttcctgatcgaaggagacttaaatcccgacaacagtgatgttgataaattgtttattcagcttgtccaaacttacaatcaactgttcgaggaaaacccgatcaatgcctccggtgtggatgcaaaagccattttaagtgcacgccttagcaagtcccgtcgcttagaaaaccttatcgcgcagctgcccggcgagaaaaagaatggtttgtttgggaaccttattgccttgagcttaggcctcaccccgaatttcaaaagtaatttcgatcttgcagaagacgccaaattacaactgtcgaaggatacttatgatgacgatctcgataatctgttagcgcagattggtgaccaatacgccgatctttttctggcggctaaaaatctgagcgacgccatcttgctttcggatattctccgcgttaacaccgaaatcacgaaagcgcctcttagtgccagcatgattaaacgttatgatgaacaccaccaggacctgaccttactcaaagcgttggttcgccagcaactgccagagaagtacaaagaaatcttctttgatcagtcaaagaatggttatgccggctatattgacgggggtgcaagccaagaggaattctacaaatttatcaagcctattctggagaaaatggatggcaccgaagagttattggtgaagcttaaccgtgaagacctcctgcggaaacagcgcacattcgataatggttcgatcccacaccaaatccatttgggggagttacacgctattttgcgtcgccaggaagacttttaccctttcctgaaggataaccgggagaaaattgagaagatccttacctttcgtattccgtattacgtaggccccttagcacggggtaatagccgtttcgcgtggatgacacggaagtcggaagagacgatcaccccgtggaacttcgaagaggtagtcgacaagggcgcatcagcgcagtcttttattgaacgtatgacgaatttcgataaaaacttgcccaatgagaaggtgcttccgaaacattccttgttatatgaatattttacagtttacaacgagctgaccaaggttaaatacgtgacggaaggaatgcgcaagcccgcttttcttagcggtgagcaaaaaaaggcgatcgtcgacctgttattcaaaacgaatcgtaaggtgactgtaaagcaactcaaagaagattacttcaaaaagattgagtgcttcgacagcgtcgaaatctctggggtagaggatcggtttaacgcaagtttaggtacctaccatgacctgcttaaaatcattaaggataaagacttcttagataatgaagagaacgaagatattctcgaggacatcgtcttgacgttaaccttatttgaggatcgtgaaatgattgaggaacgcctcaaaacttatgcccacctgttcgacgataaggtgatgaagcagctgaaacgtcggcgctacacaggatggggccgcttgagtcgcaaacttattaacggaatccgtgacaagcaatccggcaaaacgattctggatttcttgaagtcggacggatttgctaatcgcaacttcatgcagttgatccatgatgactccctgacttttaaagaggatattcaaaaggcgcaggttagtggtcaaggcgacagcttacacgaacacatcgcaaatttggctggttcgccggccattaaaaaggggatcctccagaccgtgaaagttgtagatgagcttgttaaggtcatgggtcgtcataagcccgaaaacatcgtgattgaaatggcgcgggagaatcaaacgacccagaaaggacaaaagaatagccgtgaacggatgaagcggatcgaggaaggcattaaagagctggggtctcaaatcttgaaggaacaccctgtggagaacactcagctccaaaatgaaaaactttacctgtactatttgcagaacggacgcgatatgtacgtggaccaagagttggatattaatcggctgagtgactacgacgttgatcatatcgtcccgcagagcttcctcaaagacgattctattgacaataaggtactgacgcgctctgataaaaaccgtggtaagtcggacaacgtgccctccgaagaggttgtgaaaaagatgaaaaattattggcgccagcttttaaacgcgaagctgatcacacaacgtaaattcgataatttgaccaaggctgaacggggtggcctgagcgagttagataaggcaggatttattaaacgccagttagtggagactcgtcaaatcaccaaacatgtcgcgcagattttggacagccggatgaacaccaagtacgatgaaaatgacaaactgatccgtgaggtgaaagtcattactctgaagtccaaattagttagtgatttccggaaggactttcaattctacaaagtccgtgaaattaataactatcatcacgcacatgacgcgtacctgaatgcagtggttgggaccgcccttatcaagaaatatcctaagctggagtcggagtttgtctatggcgactataaggtatacgatgttcgcaaaatgattgcgaaatctgagcaggagatcggtaaggcaaccgcaaaatatttcttttactcaaacattatgaatttctttaagacagaaatcactctggccaacggggagattcgcaaacgtccgttgatcgaaacaaacggcgagactggcgaaattgtttgggacaaagggcgtgatttcgcgacggtgcgcaaggtactgagcatgcctcaagtcaatattgttaagaaaaccgaagtgcagacgggcgggttttccaaggaaagcatcttacccaaacgtaattcagataaacttattgcacgcaaaaaggactgggatccgaaaaagtatggaggcttcgacagtccaaccgtagcctactctgttctcgttgtagcgaaagtagaaaagggtaaatccaagaaactgaaatctgtcaaggagttgcttggaatcaccattatggagcgtagctccttcgagaagaacccgattgactttctggaagccaaaggatataaagaggtcaagaaagatcttatcattaagctgcctaagtattcactcttcgagctggaaaatggtcgtaaacgcatgctcgcttctgccggcgagttgcagaagggcaatgaattagcacttccatcaaagtacgttaacttcctgtatttggccagccattacgagaaactgaaggggtctccagaggacaacgaacagaaacaattatttgtagagcagcacaagcattatcttgatgaaatcattgagcaaatttccgaattcagtaaacgcgtaatcctggccgatgcaaacctcgacaaggtgctgagcgcttacaataagcatcgcgacaaacctatccgtgagcaggctgaaaatatcattcacctgttcacattaacgaacctgggcgctccggccgcttttaaatatttcgacacgacaatcgaccgtaagcgctataccagtacgaaagaagtgttggatgcgacccttattcaccagtcaattacaggattatatgagacccgtatcgaccttagccaattaggtggggatggaggcggaggatcaggcggtggcggaagtggtggaggtgggtcgggaggtggtggtagcatggttagcaaaggtgaagaactgtttaccggcgttgtgccgattctggtggaactggatggtgatgtgaatggccataaatttagcgttagcggcgaaggcgaaggtgatgcgacctatggtaaactgaccctgaaatttatttgcaccaccggtaaactgccggttccgtggccgaccctggtgaccaccctgacctatggcgttcagtgctttagccgctatccggatcatatgaaacagcatgatttctttaaaagcgcgatgccggaaggctatgtgcaggaacgtaccatttttttcaaagatgatggcaactataaaacccgtgcggaagttaaatttgaaggcgataccctggtgaaccgcattgaactgaaaggtattgattttaaagaagatggcaacattctgggtcataaactggaatataattacaacagccataatgtgtatattatggccgataaacagaaaaatggcatcaaagtgaactttaaaatccgtcacaacattgaagatggtagcgtgcagctggcggatcattatcagcagaataccccgattggtgatggcccggtgctgctgccggataatcattatctgagcacccagagcgcgctgagcaaagatccgaatgaaaaacgtgatcatatggtgctgctggaatttgttaccgccgcgggcattaccctgggtatggatgaactgtataaa

SEQ ID NO: 350 - DNA, 4866 bp, Artificial Sequence
  SYNTHETIC
atggacaaaaagtactctattggcctggatatcgggaccaacagcgtcgggtgggctgttatcaccgacgagtataaagtaccttcgaaaaagttcaaagtgctgggcaacaccgatcgccattcaatcaaaaagaacttgattggtgcgctgttgtttgactccggggaaaccgccgaggcgactcgccttaaacgtacagcacgtcgccggtacactcggcgtaagaatcgcatttgctatttgcaggaaatctttagcaacgagatggcaaaagtcgatgactcgtttttccaccgcctcgaggaaagctttctggtggaggaagacaaaaagcatgagcgtcacccgatcttcggcaacattgtcgatgaagtagcgtatcatgaaaaatacccaaccatttaccacttacgcaaaaagctggtggacagcactgacaaagctgatttgcgccttatctatttagccctggcacatatgattaagtttcgtggtcacttcctgatcgaaggagacttaaatcccgacaacagtgatgttgataaattgtttattcagcttgtccaaacttacaatcaactgttcgaggaaaacccgatcaatgcctccggtgtggatgcaaaagccattttaagtgcacgccttagcaagtcccgtcgcttagaaaaccttatcgcgcagctgcccggcgagaaaaagaatggtttgtttgggaaccttattgccttgagcttaggcctcaccccgaatttcaaaagtaatttcgatcttgcagaagacgccaaattacaactgtcgaaggatacttatgatgacgatctcgataatctgttagcgcagattggtgaccaatacgccgatctttttctggcggctaaaaatctgagcgacgccatcttgctttcggatattctccgcgttaacaccgaaatcacgaaagcgcctcttagtgccagcatgattaaacgttatgatgaacaccaccaggacctgaccttactcaaagcgttggttcgccagcaactgccagagaagtacaaagaaatcttctttgatcagtcaaagaatggttatgccggctatattgacgggggtgcaagccaagaggaattctacaaatttatcaagcctattctggagaaaatggatggcaccgaagagttattggtgaagcttaaccgtgaagacctcctgcggaaacagcgcacattcgataatggttcgatcccacaccaaatccatttgggggagttacacgctattttgcgtcgccaggaagacttttaccctttcctgaaggataaccgggagaaaattgagaagatccttacctttcgtattccgtattacgtaggccccttagcacggggtaatagccgtttcgcgtggatgacacggaagtcggaagagacgatcaccccgtggaacttcgaagaggtagtcgacaagggcgcatcagcgcagtcttttattgaacgtatgacgaatttcgataaaaacttgcccaatgagaaggtgcttccgaaacattccttgttatatgaatattttacagtttacaacgagctgaccaaggttaaatacgtgacggaaggaatgcgcaagcccgcttttcttagcggtgagcaaaaaaaggcgatcgtcgacctgttattcaaaacgaatcgtaaggtgactgtaaagcaactcaaagaagattacttcaaaaagattgagtgcttcgacagcgtcgaaatctctggggtagaggatcggtttaacgcaagtttaggtacctaccatgacctgcttaaaatcattaaggataaagacttcttagataatgaagagaacgaagatattctcgaggacatcgtcttgacgttaaccttatttgaggatcgtgaaatgattgaggaacgcctcaaaacttatgcccacctgttcgacgataaggtgatgaagcagctgaaacgtcggcgctacacaggatggggccgcttgagtcgcaaacttattaacggaatccgtgacaagcaatccggcaaaacgattctggatttcttgaagtcggacggatttgctaatcgcaacttcatgcagttgatccatgatgactccctgacttttaaagaggatattcaaaaggcgcaggttagtggtcaaggcgacagcttacacgaacacatcgcaaatttggctggttcgccggccattaaaaaggggatcctccagaccgtgaaagttgtagatgagcttgttaaggtcatgggtcgtcataagcccgaaaacatcgtgattgaaatggcgcgggagaatcaaacgacccagaaaggacaaaagaatagccgtgaacggatgaagcggatcgaggaaggcattaaagagctggggtctcaaatcttgaaggaacaccctgtggagaacactcagctccaaaatgaaaaactttacctgtactatttgcagaacggacgcgatatgtacgtggaccaagagttggatattaatcggctgagtgactacgacgttgatcatatcgtcccgcagagcttcctcaaagacgattctattgacaataaggtactgacgcgctctgataaaaaccgtggtaagtcggacaacgtgccctccgaagaggttgtgaaaaagatgaaaaattattggcgccagcttttaaacgcgaagctgatcacacaacgtaaattcgataatttgaccaaggctgaacggggtggcctgagcgagttagataaggcaggatttattaaacgccagttagtggagactcgtcaaatcaccaaacatgtcgcgcagattttggacagccggatgaacaccaagtacgatgaaaatgacaaactgatccgtgaggtgaaagtcattactctgaagtccaaattagttagtgatttccggaaggactttcaattctacaaagtccgtgaaattaataactatcatcacgcacatgacgcgtacctgaatgcagtggttgggaccgcccttatcaagaaatatcctaagctggagtcggagtttgtctatggcgactataaggtatacgatgttcgcaaaatgattgcgaaatctgagcaggagatcggtaaggcaaccgcaaaatatttcttttactcaaacattatgaatttctttaagacagaaatcactctggccaacggggagattcgcaaacgtccgttgatcgaaacaaacggcgagactggcgaaattgtttgggacaaagggcgtgatttcgcgacggtgcgcaaggtactgagcatgcctcaagtcaatattgttaagaaaaccgaagtgcagacgggcgggttttccaaggaaagcatcttacccaaacgtaattcagataaacttattgcacgcaaaaaggactgggatccgaaaaagtatggaggcttcgacagtccaaccgtagcctactctgttctcgttgtagcgaaagtagaaaagggtaaatccaagaaactgaaatctgtcaaggagttgcttggaatcaccattatggagcgtagctccttcgagaagaacccgattgactttctggaagccaaaggatataaagaggtcaagaaagatcttatcattaagctgcctaagtattcactcttcgagctggaaaatggtcgtaaacgcatgctcgcttctgccggcgagttgcagaagggcaatgaattagcacttccatcaaagtacgttaacttcctgtatttggccagccattacgagaaactgaaggggtctccagaggacaacgaacagaaacaattatttgtagagcagcacaagcattatcttgatgaaatcattgagcaaatttccgaattcagtaaacgcgtaatcctggccgatgcaaacctcgacaaggtgctgagcgcttacaataagcatcgcgacaaacctatccgtgagcaggctgaaaatatcattcacctgttcacattaacgaacctgggcgctccggccgcttttaaatatttcgacacgacaatcgaccgtaagcgctataccagtacgaaagaagtgttggatgcgacccttattcaccagtcaattacaggattatatgagacccgtatcgaccttagccaattaggtggggatggaggcggagggtcggaagcggcagcaaaaggaggcggaggaagtatggttagcaaaggtgaagaactgtttaccggcgttgtgccgattctggtggaactggatggtgatgtgaatggccataaatttagcgttagcggcgaaggcgaaggtgatgcgacctatggtaaactgaccctgaaatttatttgcaccaccggtaaactgccggttccgtggccgaccctggtgaccaccctgacctatggcgttcagtgctttagccgctatccggatcatatgaaacagcatgatttctttaaaagcgcgatgccggaaggctatgtgcaggaacgtaccatttttttcaaagatgatggcaactataaaacccgtgcggaagttaaatttgaaggcgataccctggtgaaccgcattgaactgaaaggtattgattttaaagaagatggcaacattctgggtcataaactggaatataattacaacagccataatgtgtatattatggccgataaacagaaaaatggcatcaaagtgaactttaaaatccgtcacaacattgaagatggtagcgtgcagctggcggatcattatcagcagaataccccgattggtgatggcccggtgctgctgccggataatcattatctgagcacccagagcgcgctgagcaaagatccgaatgaaaaacgtgatcatatggtgctgctggaatttgttaccgccgcgggcattaccctgggtatggatgaactgtataaa

SEQ ID NO: 351 - DNA, 4887 bp, Artificial Sequence
  SYNTHETIC
atggacaaaaagtactctattggcctggatatcgggaccaacagcgtcgggtgggctgttatcaccgacgagtataaagtaccttcgaaaaagttcaaagtgctgggcaacaccgatcgccattcaatcaaaaagaacttgattggtgcgctgttgtttgactccggggaaaccgccgaggcgactcgccttaaacgtacagcacgtcgccggtacactcggcgtaagaatcgcatttgctatttgcaggaaatctttagcaacgagatggcaaaagtcgatgactcgtttttccaccgcctcgaggaaagctttctggtggaggaagacaaaaagcatgagcgtcacccgatcttcggcaacattgtcgatgaagtagcgtatcatgaaaaatacccaaccatttaccacttacgcaaaaagctggtggacagcactgacaaagctgatttgcgccttatctatttagccctggcacatatgattaagtttcgtggtcacttcctgatcgaaggagacttaaatcccgacaacagtgatgttgataaattgtttattcagcttgtccaaacttacaatcaactgttcgaggaaaacccgatcaatgcctccggtgtggatgcaaaagccattttaagtgcacgccttagcaagtcccgtcgcttagaaaaccttatcgcgcagctgcccggcgagaaaaagaatggtttgtttgggaaccttattgccttgagcttaggcctcaccccgaatttcaaaagtaatttcgatcttgcagaagacgccaaattacaactgtcgaaggatacttatgatgacgatctcgataatctgttagcgcagattggtgaccaatacgccgatctttttctggcggctaaaaatctgagcgacgccatcttgctttcggatattctccgcgttaacaccgaaatcacgaaagcgcctcttagtgccagcatgattaaacgttatgatgaacaccaccaggacctgaccttactcaaagcgttggttcgccagcaactgccagagaagtacaaagaaatcttctttgatcagtcaaagaatggttatgccggctatattgacgggggtgcaagccaagaggaattctacaaatttatcaagcctattctggagaaaatggatggcaccgaagagttattggtgaagcttaaccgtgaagacctcctgcggaaacagcgcacattcgataatggttcgatcccacaccaaatccatttgggggagttacacgctattttgcgtcgccaggaagacttttaccctttcctgaaggataaccgggagaaaattgagaagatccttacctttcgtattccgtattacgtaggccccttagcacggggtaatagccgtttcgcgtggatgacacggaagtcggaagagacgatcaccccgtggaacttcgaagaggtagtcgacaagggcgcatcagcgcagtcttttattgaacgtatgacgaatttcgataaaaacttgcccaatgagaaggtgcttccgaaacattccttgttatatgaatattttacagtttacaacgagctgaccaaggttaaatacgtgacggaaggaatgcgcaagcccgcttttcttagcggtgagcaaaaaaaggcgatcgtcgacctgttattcaaaacgaatcgtaaggtgactgtaaagcaactcaaagaagattacttcaaaaagattgagtgcttcgacagcgtcgaaatctctggggtagaggatcggtttaacgcaagtttaggtacctaccatgacctgcttaaaatcattaaggataaagacttcttagataatgaagagaacgaagatattctcgaggacatcgtcttgacgttaaccttatttgaggatcgtgaaatgattgaggaacgcctcaaaacttatgcccacctgttcgacgataaggtgatgaagcagctgaaacgtcggcgctacacaggatggggccgcttgagtcgcaaacttattaacggaatccgtgacaagcaatccggcaaaacgattctggatttcttgaagtcggacggatttgctaatcgcaacttcatgcagttgatccatgatgactccctgacttttaaagaggatattcaaaaggcgcaggttagtggtcaaggcgacagcttacacgaacacatcgcaaatttggctggttcgccggccattaaaaaggggatcctccagaccgtgaaagttgtagatgagcttgttaaggtcatgggtcgtcataagcccgaaaacatcgtgattgaaatggcgcgggagaatcaaacgacccagaaaggacaaaagaatagccgtgaacggatgaagcggatcgaggaaggcattaaagagctggggtctcaaatcttgaaggaacaccctgtggagaacactcagctccaaaatgaaaaactttacctgtactatttgcagaacggacgcgatatgtacgtggaccaagagttggatattaatcggctgagtgactacgacgttgatcatatcgtcccgcagagcttcctcaaagacgattctattgacaataaggtactgacgcgctctgataaaaaccgtggtaagtcggacaacgtgccctccgaagaggttgtgaaaaagatgaaaaattattggcgccagcttttaaacgcgaagctgatcacacaacgtaaattcgataatttgaccaaggctgaacggggtggcctgagcgagttagataaggcaggatttattaaacgccagttagtggagactcgtcaaatcaccaaacatgtcgcgcagattttggacagccggatgaacaccaagtacgatgaaaatgacaaactgatccgtgaggtgaaagtcattactctgaagtccaaattagttagtgatttccggaaggactttcaattctacaaagtccgtgaaattaataactatcatcacgcacatgacgcgtacctgaatgcagtggttgggaccgcccttatcaagaaatatcctaagctggagtcggagtttgtctatggcgactataaggtatacgatgttcgcaaaatgattgcgaaatctgagcaggagatcggtaaggcaaccgcaaaatatttcttttactcaaacattatgaatttctttaagacagaaatcactctggccaacggggagattcgcaaacgtccgttgatcgaaacaaacggcgagactggcgaaattgtttgggacaaagggcgtgatttcgcgacggtgcgcaaggtactgagcatgcctcaagtcaatattgttaagaaaaccgaagtgcagacgggcgggttttccaaggaaagcatcttacccaaacgtaattcagataaacttattgcacgcaaaaaggactgggatccgaaaaagtatggaggcttcgacagtccaaccgtagcctactctgttctcgttgtagcgaaagtagaaaagggtaaatccaagaaactgaaatctgtcaaggagttgcttggaatcaccattatggagcgtagctccttcgagaagaacccgattgactttctggaagccaaaggatataaagaggtcaagaaagatcttatcattaagctgcctaagtattcactcttcgagctggaaaatggtcgtaaacgcatgctcgcttctgccggcgagttgcagaagggcaatgaattagcacttccatcaaagtacgttaacttcctgtatttggccagccattacgagaaactgaaggggtctccagaggacaacgaacagaaacaattatttgtagagcagcacaagcattatcttgatgaaatcattgagcaaatttccgaattcagtaaacgcgtaatcctggccgatgcaaacctcgacaaggtgctgagcgcttacaataagcatcgcgacaaacctatccgtgagcaggctgaaaatatcattcacctgttcacattaacgaacctgggcgctccggccgcttttaaatatttcgacacgacaatcgaccgtaagcgctataccagtacgaaagaagtgttggatgcgacccttattcaccagtcaattacaggattatatgagacccgtatcgaccttagccaattaggtggggatgctgaggccgcagcaaaagaggctgccgctaaggaggctgctgcaaaagaagcagcagcgaaagctatggttagcaaaggtgaagaactgtttaccggcgttgtgccgattctggtggaactggatggtgatgtgaatggccataaatttagcgttagcggcgaaggcgaaggtgatgcgacctatggtaaactgaccctgaaatttatttgcaccaccggtaaactgccggttccgtggccgaccctggtgaccaccctgacctatggcgttcagtgctttagccgctatccggatcatatgaaacagcatgatttctttaaaagcgcgatgccggaaggctatgtgcaggaacgtaccatttttttcaaagatgatggcaactataaaacccgtgcggaagttaaatttgaaggcgataccctggtgaaccgcattgaactgaaaggtattgattttaaagaagatggcaacattctgggtcataaactggaatataattacaacagccataatgtgtatattatggccgataaacagaaaaatggcatcaaagtgaactttaaaatccgtcacaacattgaagatggtagcgtgcagctggcggatcattatcagcagaataccccgattggtgatggcccggtgctgctgccggataatcattatctgagcacccagagcgcgctgagcaaagatccgaatgaaaaacgtgatcatatggtgctgctggaatttgttaccgccgcgggcattaccctgggtatggatgaactgtataaa

SEQ ID NO: 352 - DNA, 4959 bp, Artificial Sequence
  SYNTHETIC
atggacaaaaagtactctattggcctggatatcgggaccaacagcgtcgggtgggctgttatcaccgacgagtataaagtaccttcgaaaaagttcaaagtgctgggcaacaccgatcgccattcaatcaaaaagaacttgattggtgcgctgttgtttgactccggggaaaccgccgaggcgactcgccttaaacgtacagcacgtcgccggtacactcggcgtaagaatcgcatttgctatttgcaggaaatctttagcaacgagatggcaaaagtcgatgactcgtttttccaccgcctcgaggaaagctttctggtggaggaagacaaaaagcatgagcgtcacccgatcttcggcaacattgtcgatgaagtagcgtatcatgaaaaatacccaaccatttaccacttacgcaaaaagctggtggacagcactgacaaagctgatttgcgccttatctatttagccctggcacatatgattaagtttcgtggtcacttcctgatcgaaggagacttaaatcccgacaacagtgatgttgataaattgtttattcagcttgtccaaacttacaatcaactgttcgaggaaaacccgatcaatgcctccggtgtggatgcaaaagccattttaagtgcacgccttagcaagtcccgtcgcttagaaaaccttatcgcgcagctgcccggcgagaaaaagaatggtttgtttgggaaccttattgccttgagcttaggcctcaccccgaatttcaaaagtaatttcgatcttgcagaagacgccaaattacaactgtcgaaggatacttatgatgacgatctcgataatctgttagcgcagattggtgaccaatacgccgatctttttctggcggctaaaaatctgagcgacgccatcttgctttcggatattctccgcgttaacaccgaaatcacgaaagcgcctcttagtgccagcatgattaaacgttatgatgaacaccaccaggacctgaccttactcaaagcgttggttcgccagcaactgccagagaagtacaaagaaatcttctttgatcagtcaaagaatggttatgccggctatattgacgggggtgcaagccaagaggaattctacaaatttatcaagcctattctggagaaaatggatggcaccgaagagttattggtgaagcttaaccgtgaagacctcctgcggaaacagcgcacattcgataatggttcgatcccacaccaaatccatttgggggagttacacgctattttgcgtcgccaggaagacttttaccctttcctgaaggataaccgggagaaaattgagaagatccttacctttcgtattccgtattacgtaggccccttagcacggggtaatagccgtttcgcgtggatgacacggaagtcggaagagacgatcaccccgtggaacttcgaagaggtagtcgacaagggcgcatcagcgcagtcttttattgaacgtatgacgaatttcgataaaaacttgcccaatgagaaggtgcttccgaaacattccttgttatatgaatattttacagtttacaacgagctgaccaaggttaaatacgtgacggaaggaatgcgcaagcccgcttttcttagcggtgagcaaaaaaaggcgatcgtcgacctgttattcaaaacgaatcgtaaggtgactgtaaagcaactcaaagaagattacttcaaaaagattgagtgcttcgacagcgtcgaaatctctggggtagaggatcggtttaacgcaagtttaggtacctaccatgacctgcttaaaatcattaaggataaagacttcttagataatgaagagaacgaagatattctcgaggacatcgtcttgacgttaaccttatttgaggatcgtgaaatgattgaggaacgcctcaaaacttatgcccacctgttcgacgataaggtgatgaagcagctgaaacgtcggcgctacacaggatggggccgcttgagtcgcaaacttattaacggaatccgtgacaagcaatccggcaaaacgattctggatttcttgaagtcggacggatttgctaatcgcaacttcatgcagttgatccatgatgactccctgacttttaaagaggatattcaaaaggcgcaggttagtggtcaaggcgacagcttacacgaacacatcgcaaatttggctggttcgccggccattaaaaaggggatcctccagaccgtgaaagttgtagatgagcttgttaaggtcatgggtcgtcataagcccgaaaacatcgtgattgaaatggcgcgggagaatcaaacgacccagaaaggacaaaagaatagccgtgaacggatgaagcggatcgaggaaggcattaaagagctggggtctcaaatcttgaaggaacaccctgtggagaacactcagctccaaaatgaaaaactttacctgtactatttgcagaacggacgcgatatgtacgtggaccaagagttggatattaatcggctgagtgactacgacgttgatcatatcgtcccgcagagcttcctcaaagacgattctattgacaataaggtactgacgcgctctgataaaaaccgtggtaagtcggacaacgtgccctccgaagaggttgtgaaaaagatgaaaaattattggcgccagcttttaaacgcgaagctgatcacacaacgtaaattcgataatttgaccaaggctgaacggggtggcctgagcgagttagataaggcaggatttattaaacgccagttagtggagactcgtcaaatcaccaaacatgtcgcgcagattttggacagccggatgaacaccaagtacgatgaaaatgacaaactgatccgtgaggtgaaagtcattactctgaagtccaaattagttagtgatttccggaaggactttcaattctacaaagtccgtgaaattaataactatcatcacgcacatgacgcgtacctgaatgcagtggttgggaccgcccttatcaagaaatatcctaagctggagtcggagtttgtctatggcgactataaggtatacgatgttcgcaaaatgattgcgaaatctgagcaggagatcggtaaggcaaccgcaaaatatttcttttactcaaacattatgaatttctttaagacagaaatcactctggccaacggggagattcgcaaacgtccgttgatcgaaacaaacggcgagactggcgaaattgtttgggacaaagggcgtgatttcgcgacggtgcgcaaggtactgagcatgcctcaagtcaatattgttaagaaaaccgaagtgcagacgggcgggttttccaaggaaagcatcttacccaaacgtaattcagataaacttattgcacgcaaaaaggactgggatccgaaaaagtatggaggcttcgacagtccaaccgtagcctactctgttctcgttgtagcgaaagtagaaaagggtaaatccaagaaactgaaatctgtcaaggagttgcttggaatcaccattatggagcgtagctccttcgagaagaacccgattgactttctggaagccaaaggatataaagaggtcaagaaagatcttatcattaagctgcctaagtattcactcttcgagctggaaaatggtcgtaaacgcatgctcgcttctgccggcgagttgcagaagggcaatgaattagcacttccatcaaagtacgttaacttcctgtatttggccagccattacgagaaactgaaggggtctccagaggacaacgaacagaaacaattatttgtagagcagcacaagcattatcttgatgaaatcattgagcaaatttccgaattcagtaaacgcgtaatcctggccgatgcaaacctcgacaaggtgctgagcgcttacaataagcatcgcgacaaacctatccgtgagcaggctgaaaatatcattcacctgttcacattaacgaacctgggcgctccggccgcttttaaatatttcgacacgacaatcgaccgtaagcgctataccagtacgaaagaagtgttggatgcgacccttattcaccagtcaattacaggattatatgagacccgtatcgaccttagccaattaggtggggatgccgaagcagcagccaaagaagctgccgcaaaggaggcggcagctaaagaagcggccgctaaggcattggaagcggaggcggctgccaaggaggctgcggcgaaagaagctgcggccaaagaagcggctgcaaaagcgatggttagcaaaggtgaagaactgtttaccggcgttgtgccgattctggtggaactggatggtgatgtgaatggccataaatttagcgttagcggcgaaggcgaaggtgatgcgacctatggtaaactgaccctgaaatttatttgcaccaccggtaaactgccggttccgtggccgaccctggtgaccaccctgacctatggcgttcagtgctttagccgctatccggatcatatgaaacagcatgatttctttaaaagcgcgatgccggaaggctatgtgcaggaacgtaccatttttttcaaagatgatggcaactataaaacccgtgcggaagttaaatttgaaggcgataccctggtgaaccgcattgaactgaaaggtattgattttaaagaagatggcaacattctgggtcataaactggaatataattacaacagccataatgtgtatattatggccgataaacagaaaaatggcatcaaagtgaactttaaaatccgtcacaacattgaagatggtagcgtgcagctggcggatcattatcagcagaataccccgattggtgatggcccggtgctgctgccggataatcattatctgagcacccagagcgcgctgagcaaagatccgaatgaaaaacgtgatcatatggtgctgctggaatttgttaccgccgcgggcattaccctgggtatggatgaactgtataaa

SEQ ID NO: 353 - DNA, 4971 bp, Artificial Sequence
  SYNTHETIC
atggacaaaaagtactctattggcctggatatcgggaccaacagcgtcgggtgggctgttatcaccgacgagtataaagtaccttcgaaaaagttcaaagtgctgggcaacaccgatcgccattcaatcaaaaagaacttgattggtgcgctgttgtttgactccggggaaaccgccgaggcgactcgccttaaacgtacagcacgtcgccggtacactcggcgtaagaatcgcatttgctatttgcaggaaatctttagcaacgagatggcaaaagtcgatgactcgtttttccaccgcctcgaggaaagctttctggtggaggaagacaaaaagcatgagcgtcacccgatcttcggcaacattgtcgatgaagtagcgtatcatgaaaaatacccaaccatttaccacttacgcaaaaagctggtggacagcactgacaaagctgatttgcgccttatctatttagccctggcacatatgattaagtttcgtggtcacttcctgatcgaaggagacttaaatcccgacaacagtgatgttgataaattgtttattcagcttgtccaaacttacaatcaactgttcgaggaaaacccgatcaatgcctccggtgtggatgcaaaagccattttaagtgcacgccttagcaagtcccgtcgcttagaaaaccttatcgcgcagctgcccggcgagaaaaagaatggtttgtttgggaaccttattgccttgagcttaggcctcaccccgaatttcaaaagtaatttcgatcttgcagaagacgccaaattacaactgtcgaaggatacttatgatgacgatctcgataatctgttagcgcagattggtgaccaatacgccgatctttttctggcggctaaaaatctgagcgacgccatcttgctttcggatattctccgcgttaacaccgaaatcacgaaagcgcctcttagtgccagcatgattaaacgttatgatgaacaccaccaggacctgaccttactcaaagcgttggttcgccagcaactgccagagaagtacaaagaaatcttctttgatcagtcaaagaatggttatgccggctatattgacgggggtgcaagccaagaggaattctacaaatttatcaagcctattctggagaaaatggatggcaccgaagagttattggtgaagcttaaccgtgaagacctcctgcggaaacagcgcacattcgataatggttcgatcccacaccaaatccatttgggggagttacacgctattttgcgtcgccaggaagacttttaccctttcctgaaggataaccgggagaaaattgagaagatccttacctttcgtattccgtattacgtaggccccttagcacggggtaatagccgtttcgcgtggatgacacggaagtcggaagagacgatcaccccgtggaacttcgaagaggtagtcgacaagggcgcatcagcgcagtcttttattgaacgtatgacgaatttcgataaaaacttgcccaatgagaaggtgcttccgaaacattccttgttatatgaatattttacagtttacaacgagctgaccaaggttaaatacgtgacggaaggaatgcgcaagcccgcttttcttagcggtgagcaaaaaaaggcgatcgtcgacctgttattcaaaacgaatcgtaaggtgactgtaaagcaactcaaagaagattacttcaaaaagattgagtgcttcgacagcgtcgaaatctctggggtagaggatcggtttaacgcaagtttaggtacctaccatgacctgcttaaaatcattaaggataaagacttcttagataatgaagagaacgaagatattctcgaggacatcgtcttgacgttaaccttatttgaggatcgtgaaatgattgaggaacgcctcaaaacttatgcccacctgttcgacgataaggtgatgaagcagctgaaacgtcggcgctacacaggatggggccgcttgagtcgcaaacttattaacggaatccgtgacaagcaatccggcaaaacgattctggatttcttgaagtcggacggatttgctaatcgcaacttcatgcagttgatccatgatgactccctgacttttaaagaggatattcaaaaggcgcaggttagtggtcaaggcgacagcttacacgaacacatcgcaaatttggctggttcgccggccattaaaaaggggatcctccagaccgtgaaagttgtagatgagcttgttaaggtcatgggtcgtcataagcccgaaaacatcgtgattgaaatggcgcgggagaatcaaacgacccagaaaggacaaaagaatagccgtgaacggatgaagcggatcgaggaaggcattaaagagctggggtctcaaatcttgaaggaacaccctgtggagaacactcagctccaaaatgaaaaactttacctgtactatttgcagaacggacgcgatatgtacgtggaccaagagttggatattaatcggctgagtgactacgacgttgatcatatcgtcccgcagagcttcctcaaagacgattctattgacaataaggtactgacgcgctctgataaaaaccgtggtaagtcggacaacgtgccctccgaagaggttgtgaaaaagatgaaaaattattggcgccagcttttaaacgcgaagctgatcacacaacgtaaattcgataatttgaccaaggctgaacggggtggcctgagcgagttagataaggcaggatttattaaacgccagttagtggagactcgtcaaatcaccaaacatgtcgcgcagattttggacagccggatgaacaccaagtacgatgaaaatgacaaactgatccgtgaggtgaaagtcattactctgaagtccaaattagttagtgatttccggaaggactttcaattctacaaagtccgtgaaattaataactatcatcacgcacatgacgcgtacctgaatgcagtggttgggaccgcccttatcaagaaatatcctaagctggagtcggagtttgtctatggcgactataaggtatacgatgttcgcaaaatgattgcgaaatctgagcaggagatcggtaaggcaaccgcaaaatatttcttttactcaaacattatgaatttctttaagacagaaatcactctggccaacggggagattcgcaaacgtccgttgatcgaaacaaacggcgagactggcgaaattgtttgggacaaagggcgtgatttcgcgacggtgcgcaaggtactgagcatgcctcaagtcaatattgttaagaaaaccgaagtgcagacgggcgggttttccaaggaaagcatcttacccaaacgtaattcagataaacttattgcacgcaaaaaggactgggatccgaaaaagtatggaggcttcgacagtccaaccgtagcctactctgttctcgttgtagcgaaagtagaaaagggtaaatccaagaaactgaaatctgtcaaggagttgcttggaatcaccattatggagcgtagctccttcgagaagaacccgattgactttctggaagccaaaggatataaagaggtcaagaaagatcttatcattaagctgcctaagtattcactcttcgagctggaaaatggtcgtaaacgcatgctcgcttctgccggcgagttgcagaagggcaatgaattagcacttccatcaaagtacgttaacttcctgtatttggccagccattacgagaaactgaaggggtctccagaggacaacgaacagaaacaattatttgtagagcagcacaagcattatcttgatgaaatcattgagcaaatttccgaattcagtaaacgcgtaatcctggccgatgcaaacctcgacaaggtgctgagcgcttacaataagcatcgcgacaaacctatccgtgagcaggctgaaaatatcattcacctgttcacattaacgaacctgggcgctccggccgcttttaaatatttcgacacgacaatcgaccgtaagcgctataccagtacgaaagaagtgttggatgcgacccttattcaccagtcaattacaggattatatgagacccgtatcgaccttagccaattaggtggggatttagaggctgaggctgctgccaaggaggctgctgcgaaggaagctgcagctaaagaggcagcggccaaagcacttgaggccgaagccgccgcgaaagaagccgctgctaaggaggcagccgccaaagaagcggcagctaaagcattagaaatggttagcaaaggtgaagaactgtttaccggcgttgtgccgattctggtggaactggatggtgatgtgaatggccataaatttagcgttagcggcgaaggcgaaggtgatgcgacctatggtaaactgaccctgaaatttatttgcaccaccggtaaactgccggttccgtggccgaccctggtgaccaccctgacctatggcgttcagtgctttagccgctatccggatcatatgaaacagcatgatttctttaaaagcgcgatgccggaaggctatgtgcaggaacgtaccatttttttcaaagatgatggcaactataaaacccgtgcggaagttaaatttgaaggcgataccctggtgaaccgcattgaactgaaaggtattgattttaaagaagatggcaacattctgggtcataaactggaatataattacaacagccataatgtgtatattatggccgataaacagaaaaatggcatcaaagtgaactttaaaatccgtcacaacattgaagatggtagcgtgcagctggcggatcattatcagcagaataccccgattggtgatggcccggtgctgctgccggataatcattatctgagcacccagagcgcgctgagcaaagatccgaatgaaaaacgtgatcatatggtgctgctggaatttgttaccgccgcgggcattaccctgggtatggatgaactgtataaa

SEQ ID NO: 354 - DNA, 4830 bp, Artificial Sequence
  SYNTHETIC
atggacaaaaagtactctattggcctggatatcgggaccaacagcgtcgggtgggctgttatcaccgacgagtataaagtaccttcgaaaaagttcaaagtgctgggcaacaccgatcgccattcaatcaaaaagaacttgattggtgcgctgttgtttgactccggggaaaccgccgaggcgactcgccttaaacgtacagcacgtcgccggtacactcggcgtaagaatcgcatttgctatttgcaggaaatctttagcaacgagatggcaaaagtcgatgactcgtttttccaccgcctcgaggaaagctttctggtggaggaagacaaaaagcatgagcgtcacccgatcttcggcaacattgtcgatgaagtagcgtatcatgaaaaatacccaaccatttaccacttacgcaaaaagctggtggacagcactgacaaagctgatttgcgccttatctatttagccctggcacatatgattaagtttcgtggtcacttcctgatcgaaggagacttaaatcccgacaacagtgatgttgataaattgtttattcagcttgtccaaacttacaatcaactgttcgaggaaaacccgatcaatgcctccggtgtggatgcaaaagccattttaagtgcacgccttagcaagtcccgtcgcttagaaaaccttatcgcgcagctgcccggcgagaaaaagaatggtttgtttgggaaccttattgccttgagcttaggcctcaccccgaatttcaaaagtaatttcgatcttgcagaagacgccaaattacaactgtcgaaggatacttatgatgacgatctcgataatctgttagcgcagattggtgaccaatacgccgatctttttctggcggctaaaaatctgagcgacgccatcttgctttcggatattctccgcgttaacaccgaaatcacgaaagcgcctcttagtgccagcatgattaaacgttatgatgaacaccaccaggacctgaccttactcaaagcgttggttcgccagcaactgccagagaagtacaaagaaatcttctttgatcagtcaaagaatggttatgccggctatattgacgggggtgcaagccaagaggaattctacaaatttatcaagcctattctggagaaaatggatggcaccgaagagttattggtgaagcttaaccgtgaagacctcctgcggaaacagcgcacattcgataatggttcgatcccacaccaaatccatttgggggagttacacgctattttgcgtcgccaggaagacttttaccctttcctgaaggataaccgggagaaaattgagaagatccttacctttcgtattccgtattacgtaggccccttagcacggggtaatagccgtttcgcgtggatgacacggaagtcggaagagacgatcaccccgtggaacttcgaagaggtagtcgacaagggcgcatcagcgcagtcttttattgaacgtatgacgaatttcgataaaaacttgcccaatgagaaggtgcttccgaaacattccttgttatatgaatattttacagtttacaacgagctgaccaaggttaaatacgtgacggaaggaatgcgcaagcccgcttttcttagcggtgagcaaaaaaaggcgatcgtcgacctgttattcaaaacgaatcgtaaggtgactgtaaagcaactcaaagaagattacttcaaaaagattgagtgcttcgacagcgtcgaaatctctggggtagaggatcggtttaacgcaagtttaggtacctaccatgacctgcttaaaatcattaaggataaagacttcttagataatgaagagaacgaagatattctcgaggacatcgtcttgacgttaaccttatttgaggatcgtgaaatgattgaggaacgcctcaaaacttatgcccacctgttcgacgataaggtgatgaagcagctgaaacgtcggcgctacacaggatggggccgcttgagtcgcaaacttattaacggaatccgtgacaagcaatccggcaaaacgattctggatttcttgaagtcggacggatttgctaatcgcaacttcatgcagttgatccatgatgactccctgacttttaaagaggatattcaaaaggcgcaggttagtggtcaaggcgacagcttacacgaacacatcgcaaatttggctggttcgccggccattaaaaaggggatcctccagaccgtgaaagttgtagatgagcttgttaaggtcatgggtcgtcataagcccgaaaacatcgtgattgaaatggcgcgggagaatcaaacgacccagaaaggacaaaagaatagccgtgaacggatgaagcggatcgaggaaggcattaaagagctggggtctcaaatcttgaaggaacaccctgtggagaacactcagctccaaaatgaaaaactttacctgtactatttgcagaacggacgcgatatgtacgtggaccaagagttggatattaatcggctgagtgactacgacgttgatcatatcgtcccgcagagcttcctcaaagacgattctattgacaataaggtactgacgcgctctgataaaaaccgtggtaagtcggacaacgtgccctccgaagaggttgtgaaaaagatgaaaaattattggcgccagcttttaaacgcgaagctgatcacacaacgtaaattcgataatttgaccaaggctgaacggggtggcctgagcgagttagataaggcaggatttattaaacgccagttagtggagactcgtcaaatcaccaaacatgtcgcgcagattttggacagccggatgaacaccaagtacgatgaaaatgacaaactgatccgtgaggtgaaagtcattactctgaagtccaaattagttagtgatttccggaaggactttcaattctacaaagtccgtgaaattaataactatcatcacgcacatgacgcgtacctgaatgcagtggttgggaccgcccttatcaagaaatatcctaagctggagtcggagtttgtctatggcgactataaggtatacgatgttcgcaaaatgattgcgaaatctgagcaggagatcggtaaggcaaccgcaaaatatttcttttactcaaacattatgaatttctttaagacagaaatcactctggccaacggggagattcgcaaacgtccgttgatcgaaacaaacggcgagactggcgaaattgtttgggacaaagggcgtgatttcgcgacggtgcgcaaggtactgagcatgcctcaagtcaatattgttaagaaaaccgaagtgcagacgggcgggttttccaaggaaagcatcttacccaaacgtaattcagataaacttattgcacgcaaaaaggactgggatccgaaaaagtatggaggcttcgacagtccaaccgtagcctactctgttctcgttgtagcgaaagtagaaaagggtaaatccaagaaactgaaatctgtcaaggagttgcttggaatcaccattatggagcgtagctccttcgagaagaacccgattgactttctggaagccaaaggatataaagaggtcaagaaagatcttatcattaagctgcctaagtattcactcttcgagctggaaaatggtcgtaaacgcatgctcgcttctgccggcgagttgcagaagggcaatgaattagcacttccatcaaagtacgttaacttcctgtatttggccagccattacgagaaactgaaggggtctccagaggacaacgaacagaaacaattatttgtagagcagcacaagcattatcttgatgaaatcattgagcaaatttccgaattcagtaaacgcgtaatcctggccgatgcaaacctcgacaaggtgctgagcgcttacaataagcatcgcgacaaacctatccgtgagcaggctgaaaatatcattcacctgttcacattaacgaacctgggcgctccggccgcttttaaatatttcgacacgacaatcgaccgtaagcgctataccagtacgaaagaagtgttggatgcgacccttattcaccagtcaattacaggattatatgagacccgtatcgaccttagccaattaggtggggatgcacctgcgatggttagcaaaggtgaagaactgtttaccggcgttgtgccgattctggtggaactggatggtgatgtgaatggccataaatttagcgttagcggcgaaggcgaaggtgatgcgacctatggtaaactgaccctgaaatttatttgcaccaccggtaaactgccggttccgtggccgaccctggtgaccaccctgacctatggcgttcagtgctttagccgctatccggatcatatgaaacagcatgatttctttaaaagcgcgatgccggaaggctatgtgcaggaacgtaccatttttttcaaagatgatggcaactataaaacccgtgcggaagttaaatttgaaggcgataccctggtgaaccgcattgaactgaaaggtattgattttaaagaagatggcaacattctgggtcataaactggaatataattacaacagccataatgtgtatattatggccgataaacagaaaaatggcatcaaagtgaactttaaaatccgtcacaacattgaagatggtagcgtgcagctggcggatcattatcagcagaataccccgattggtgatggcccggtgctgctgccggataatcattatctgagcacccagagcgcgctgagcaaagatccgaatgaaaaacgtgatcatatggtgctgctggaatttgttaccgccgcgggcattaccctgggtatggatgaactgtataaa

SEQ ID NO: 355 - DNA, 4836 bp, Artificial Sequence
  SYNTHETIC
atggacaaaaagtactctattggcctggatatcgggaccaacagcgtcgggtgggctgttatcaccgacgagtataaagtaccttcgaaaaagttcaaagtgctgggcaacaccgatcgccattcaatcaaaaagaacttgattggtgcgctgttgtttgactccggggaaaccgccgaggcgactcgccttaaacgtacagcacgtcgccggtacactcggcgtaagaatcgcatttgctatttgcaggaaatctttagcaacgagatggcaaaagtcgatgactcgtttttccaccgcctcgaggaaagctttctggtggaggaagacaaaaagcatgagcgtcacccgatcttcggcaacattgtcgatgaagtagcgtatcatgaaaaatacccaaccatttaccacttacgcaaaaagctggtggacagcactgacaaagctgatttgcgccttatctatttagccctggcacatatgattaagtttcgtggtcacttcctgatcgaaggagacttaaatcccgacaacagtgatgttgataaattgtttattcagcttgtccaaacttacaatcaactgttcgaggaaaacccgatcaatgcctccggtgtggatgcaaaagccattttaagtgcacgccttagcaagtcccgtcgcttagaaaaccttatcgcgcagctgcccggcgagaaaaagaatggtttgtttgggaaccttattgccttgagcttaggcctcaccccgaatttcaaaagtaatttcgatcttgcagaagacgccaaattacaactgtcgaaggatacttatgatgacgatctcgataatctgttagcgcagattggtgaccaatacgccgatctttttctggcggctaaaaatctgagcgacgccatcttgctttcggatattctccgcgttaacaccgaaatcacgaaagcgcctcttagtgccagcatgattaaacgttatgatgaacaccaccaggacctgaccttactcaaagcgttggttcgccagcaactgccagagaagtacaaagaaatcttctttgatcagtcaaagaatggttatgccggctatattgacgggggtgcaagccaagaggaattctacaaatttatcaagcctattctggagaaaatggatggcaccgaagagttattggtgaagcttaaccgtgaagacctcctgcggaaacagcgcacattcgataatggttcgatcccacaccaaatccatttgggggagttacacgctattttgcgtcgccaggaagacttttaccctttcctgaaggataaccgggagaaaattgagaagatccttacctttcgtattccgtattacgtaggccccttagcacggggtaatagccgtttcgcgtggatgacacggaagtcggaagagacgatcaccccgtggaacttcgaagaggtagtcgacaagggcgcatcagcgcagtcttttattgaacgtatgacgaatttcgataaaaacttgcccaatgagaaggtgcttccgaaacattccttgttatatgaatattttacagtttacaacgagctgaccaaggttaaatacgtgacggaaggaatgcgcaagcccgcttttcttagcggtgagcaaaaaaaggcgatcgtcgacctgttattcaaaacgaatcgtaaggtgactgtaaagcaactcaaagaagattacttcaaaaagattgagtgcttcgacagcgtcgaaatctctggggtagaggatcggtttaacgcaagtttaggtacctaccatgacctgcttaaaatcattaaggataaagacttcttagataatgaagagaacgaagatattctcgaggacatcgtcttgacgttaaccttatttgaggatcgtgaaatgattgaggaacgcctcaaaacttatgcccacctgttcgacgataaggtgatgaagcagctgaaacgtcggcgctacacaggatggggccgcttgagtcgcaaacttattaacggaatccgtgacaagcaatccggcaaaacgattctggatttcttgaagtcggacggatttgctaatcgcaacttcatgcagttgatccatgatgactccctgacttttaaagaggatattcaaaaggcgcaggttagtggtcaaggcgacagcttacacgaacacatcgcaaatttggctggttcgccggccattaaaaaggggatcctccagaccgtgaaagttgtagatgagcttgttaaggtcatgggtcgtcataagcccgaaaacatcgtgattgaaatggcgcgggagaatcaaacgacccagaaaggacaaaagaatagccgtgaacggatgaagcggatcgaggaaggcattaaagagctggggtctcaaatcttgaaggaacaccctgtggagaacactcagctccaaaatgaaaaactttacctgtactatttgcagaacggacgcgatatgtacgtggaccaagagttggatattaatcggctgagtgactacgacgttgatcatatcgtcccgcagagcttcctcaaagacgattctattgacaataaggtactgacgcgctctgataaaaaccgtggtaagtcggacaacgtgccctccgaagaggttgtgaaaaagatgaaaaattattggcgccagcttttaaacgcgaagctgatcacacaacgtaaattcgataatttgaccaaggctgaacggggtggcctgagcgagttagataaggcaggatttattaaacgccagttagtggagactcgtcaaatcaccaaacatgtcgcgcagattttggacagccggatgaacaccaagtacgatgaaaatgacaaactgatccgtgaggtgaaagtcattactctgaagtccaaattagttagtgatttccggaaggactttcaattctacaaagtccgtgaaattaataactatcatcacgcacatgacgcgtacctgaatgcagtggttgggaccgcccttatcaagaaatatcctaagctggagtcggagtttgtctatggcgactataaggtatacgatgttcgcaaaatgattgcgaaatctgagcaggagatcggtaaggcaaccgcaaaatatttcttttactcaaacattatgaatttctttaagacagaaatcactctggccaacggggagattcgcaaacgtccgttgatcgaaacaaacggcgagactggcgaaattgtttgggacaaagggcgtgatttcgcgacggtgcgcaaggtactgagcatgcctcaagtcaatattgttaagaaaaccgaagtgcagacgggcgggttttccaaggaaagcatcttacccaaacgtaattcagataaacttattgcacgcaaaaaggactgggatccgaaaaagtatggaggcttcgacagtccaaccgtagcctactctgttctcgttgtagcgaaagtagaaaagggtaaatccaagaaactgaaatctgtcaaggagttgcttggaatcaccattatggagcgtagctccttcgagaagaacccgattgactttctggaagccaaaggatataaagaggtcaagaaagatcttatcattaagctgcctaagtattcactcttcgagctggaaaatggtcgtaaacgcatgctcgcttctgccggcgagttgcagaagggcaatgaattagcacttccatcaaagtacgttaacttcctgtatttggccagccattacgagaaactgaaggggtctccagaggacaacgaacagaaacaattatttgtagagcagcacaagcattatcttgatgaaatcattgagcaaatttccgaattcagtaaacgcgtaatcctggccgatgcaaacctcgacaaggtgctgagcgcttacaataagcatcgcgacaaacctatccgtgagcaggctgaaaatatcattcacctgttcacattaacgaacctgggcgctccggccgcttttaaatatttcgacacgacaatcgaccgtaagcgctataccagtacgaaagaagtgttggatgcgacccttattcaccagtcaattacaggattatatgagacccgtatcgaccttagccaattaggtggggatgctcctgcacctgcgatggttagcaaaggtgaagaactgtttaccggcgttgtgccgattctggtggaactggatggtgatgtgaatggccataaatttagcgttagcggcgaaggcgaaggtgatgcgacctatggtaaactgaccctgaaatttatttgcaccaccggtaaactgccggttccgtggccgaccctggtgaccaccctgacctatggcgttcagtgctttagccgctatccggatcatatgaaacagcatgatttctttaaaagcgcgatgccggaaggctatgtgcaggaacgtaccatttttttcaaagatgatggcaactataaaacccgtgcggaagttaaatttgaaggcgataccctggtgaaccgcattgaactgaaaggtattgattttaaagaagatggcaacattctgggtcataaactggaatataattacaacagccataatgtgtatattatggccgataaacagaaaaatggcatcaaagtgaactttaaaatccgtcacaacattgaagatggtagcgtgcagctggcggatcattatcagcagaataccccgattggtgatggcccggtgctgctgccggataatcattatctgagcacccagagcgcgctgagcaaagatccgaatgaaaaacgtgatcatatggtgctgctggaatttgttaccgccgcgggcattaccctgggtatggatgaactgtataaa

SEQ ID NO: 356 - DNA, 4842 bp, Artificial Sequence
  SYNTHETIC
atggacaaaaagtactctattggcctggatatcgggaccaacagcgtcgggtgggctgttatcaccgacgagtataaagtaccttcgaaaaagttcaaagtgctgggcaacaccgatcgccattcaatcaaaaagaacttgattggtgcgctgttgtttgactccggggaaaccgccgaggcgactcgccttaaacgtacagcacgtcgccggtacactcggcgtaagaatcgcatttgctatttgcaggaaatctttagcaacgagatggcaaaagtcgatgactcgtttttccaccgcctcgaggaaagctttctggtggaggaagacaaaaagcatgagcgtcacccgatcttcggcaacattgtcgatgaagtagcgtatcatgaaaaatacccaaccatttaccacttacgcaaaaagctggtggacagcactgacaaagctgatttgcgccttatctatttagccctggcacatatgattaagtttcgtggtcacttcctgatcgaaggagacttaaatcccgacaacagtgatgttgataaattgtttattcagcttgtccaaacttacaatcaactgttcgaggaaaacccgatcaatgcctccggtgtggatgcaaaagccattttaagtgcacgccttagcaagtcccgtcgcttagaaaaccttatcgcgcagctgcccggcgagaaaaagaatggtttgtttgggaaccttattgccttgagcttaggcctcaccccgaatttcaaaagtaatttcgatcttgcagaagacgccaaattacaactgtcgaaggatacttatgatgacgatctcgataatctgttagcgcagattggtgaccaatacgccgatctttttctggcggctaaaaatctgagcgacgccatcttgctttcggatattctccgcgttaacaccgaaatcacgaaagcgcctcttagtgccagcatgattaaacgttatgatgaacaccaccaggacctgaccttactcaaagcgttggttcgccagcaactgccagagaagtacaaagaaatcttctttgatcagtcaaagaatggttatgccggctatattgacgggggtgcaagccaagaggaattctacaaatttatcaagcctattctggagaaaatggatggcaccgaagagttattggtgaagcttaaccgtgaagacctcctgcggaaacagcgcacattcgataatggttcgatcccacaccaaatccatttgggggagttacacgctattttgcgtcgccaggaagacttttaccctttcctgaaggataaccgggagaaaattgagaagatccttacctttcgtattccgtattacgtaggccccttagcacggggtaatagccgtttcgcgtggatgacacggaagtcggaagagacgatcaccccgtggaacttcgaagaggtagtcgacaagggcgcatcagcgcagtcttttattgaacgtatgacgaatttcgataaaaacttgcccaatgagaaggtgcttccgaaacattccttgttatatgaatattttacagtttacaacgagctgaccaaggttaaatacgtgacggaaggaatgcgcaagcccgcttttcttagcggtgagcaaaaaaaggcgatcgtcgacctgttattcaaaacgaatcgtaaggtgactgtaaagcaactcaaagaagattacttcaaaaagattgagtgcttcgacagcgtcgaaatctctggggtagaggatcggtttaacgcaagtttaggtacctaccatgacctgcttaaaatcattaaggataaagacttcttagataatgaagagaacgaagatattctcgaggacatcgtcttgacgttaaccttatttgaggatcgtgaaatgattgaggaacgcctcaaaacttatgcccacctgttcgacgataaggtgatgaagcagctgaaacgtcggcgctacacaggatggggccgcttgagtcgcaaacttattaacggaatccgtgacaagcaatccggcaaaacgattctggatttcttgaagtcggacggatttgctaatcgcaacttcatgcagttgatccatgatgactccctgacttttaaagaggatattcaaaaggcgcaggttagtggtcaaggcgacagcttacacgaacacatcgcaaatttggctggttcgccggccattaaaaaggggatcctccagaccgtgaaagttgtagatgagcttgttaaggtcatgggtcgtcataagcccgaaaacatcgtgattgaaatggcgcgggagaatcaaacgacccagaaaggacaaaagaatagccgtgaacggatgaagcggatcgaggaaggcattaaagagctggggtctcaaatcttgaaggaacaccctgtggagaacactcagctccaaaatgaaaaactttacctgtactatttgcagaacggacgcgatatgtacgtggaccaagagttggatattaatcggctgagtgactacgacgttgatcatatcgtcccgcagagcttcctcaaagacgattctattgacaataaggtactgacgcgctctgataaaaaccgtggtaagtcggacaacgtgccctccgaagaggttgtgaaaaagatgaaaaattattggcgccagcttttaaacgcgaagctgatcacacaacgtaaattcgataatttgaccaaggctgaacggggtggcctgagcgagttagataaggcaggatttattaaacgccagttagtggagactcgtcaaatcaccaaacatgtcgcgcagattttggacagccggatgaacaccaagtacgatgaaaatgacaaactgatccgtgaggtgaaagtcattactctgaagtccaaattagttagtgatttccggaaggactttcaattctacaaagtccgtgaaattaataactatcatcacgcacatgacgcgtacctgaatgcagtggttgggaccgcccttatcaagaaatatcctaagctggagtcggagtttgtctatggcgactataaggtatacgatgttcgcaaaatgattgcgaaatctgagcaggagatcggtaaggcaaccgcaaaatatttcttttactcaaacattatgaatttctttaagacagaaatcactctggccaacggggagattcgcaaacgtccgttgatcgaaacaaacggcgagactggcgaaattgtttgggacaaagggcgtgatttcgcgacggtgcgcaaggtactgagcatgcctcaagtcaatattgttaagaaaaccgaagtgcagacgggcgggttttccaaggaaagcatcttacccaaacgtaattcagataaacttattgcacgcaaaaaggactgggatccgaaaaagtatggaggcttcgacagtccaaccgtagcctactctgttctcgttgtagcgaaagtagaaaagggtaaatccaagaaactgaaatctgtcaaggagttgcttggaatcaccattatggagcgtagctccttcgagaagaacccgattgactttctggaagccaaaggatataaagaggtcaagaaagatcttatcattaagctgcctaagtattcactcttcgagctggaaaatggtcgtaaacgcatgctcgcttctgccggcgagttgcagaagggcaatgaattagcacttccatcaaagtacgttaacttcctgtatttggccagccattacgagaaactgaaggggtctccagaggacaacgaacagaaacaattatttgtagagcagcacaagcattatcttgatgaaatcattgagcaaatttccgaattcagtaaacgcgtaatcctggccgatgcaaacctcgacaaggtgctgagcgcttacaataagcatcgcgacaaacctatccgtgagcaggctgaaaatatcattcacctgttcacattaacgaacctgggcgctccggccgcttttaaatatttcgacacgacaatcgaccgtaagcgctataccagtacgaaagaagtgttggatgcgacccttattcaccagtcaattacaggattatatgagacccgtatcgaccttagccaattaggtggggatgcgccagctcctgcacctgcgatggttagcaaaggtgaagaactgtttaccggcgttgtgccgattctggtggaactggatggtgatgtgaatggccataaatttagcgttagcggcgaaggcgaaggtgatgcgacctatggtaaactgaccctgaaatttatttgcaccaccggtaaactgccggttccgtggccgaccctggtgaccaccctgacctatggcgttcagtgctttagccgctatccggatcatatgaaacagcatgatttctttaaaagcgcgatgccggaaggctatgtgcaggaacgtaccatttttttcaaagatgatggcaactataaaacccgtgcggaagttaaatttgaaggcgataccctggtgaaccgcattgaactgaaaggtattgattttaaagaagatggcaacattctgggtcataaactggaatataattacaacagccataatgtgtatattatggccgataaacagaaaaatggcatcaaagtgaactttaaaatccgtcacaacattgaagatggtagcgtgcagctggcggatcattatcagcagaataccccgattggtgatggcccggtgctgctgccggataatcattatctgagcacccagagcgcgctgagcaaagatccgaatgaaaaacgtgatcatatggtgctgctggaatttgttaccgccgcgggcattaccctgggtatggatgaactgtataaa

SEQ ID NO: 357 - DNA, 4848 bp, Artificial Sequence
  SYNTHETIC
atggacaaaaagtactctattggcctggatatcgggaccaacagcgtcgggtgggctgttatcaccgacgagtataaagtaccttcgaaaaagttcaaagtgctgggcaacaccgatcgccattcaatcaaaaagaacttgattggtgcgctgttgtttgactccggggaaaccgccgaggcgactcgccttaaacgtacagcacgtcgccggtacactcggcgtaagaatcgcatttgctatttgcaggaaatctttagcaacgagatggcaaaagtcgatgactcgtttttccaccgcctcgaggaaagctttctggtggaggaagacaaaaagcatgagcgtcacccgatcttcggcaacattgtcgatgaagtagcgtatcatgaaaaatacccaaccatttaccacttacgcaaaaagctggtggacagcactgacaaagctgatttgcgccttatctatttagccctggcacatatgattaagtttcgtggtcacttcctgatcgaaggagacttaaatcccgacaacagtgatgttgataaattgtttattcagcttgtccaaacttacaatcaactgttcgaggaaaacccgatcaatgcctccggtgtggatgcaaaagccattttaagtgcacgccttagcaagtcccgtcgcttagaaaaccttatcgcgcagctgcccggcgagaaaaagaatggtttgtttgggaaccttattgccttgagcttaggcctcaccccgaatttcaaaagtaatttcgatcttgcagaagacgccaaattacaactgtcgaaggatacttatgatgacgatctcgataatctgttagcgcagattggtgaccaatacgccgatctttttctggcggctaaaaatctgagcgacgccatcttgctttcggatattctccgcgttaacaccgaaatcacgaaagcgcctcttagtgccagcatgattaaacgttatgatgaacaccaccaggacctgaccttactcaaagcgttggttcgccagcaactgccagagaagtacaaagaaatcttctttgatcagtcaaagaatggttatgccggctatattgacgggggtgcaagccaagaggaattctacaaatttatcaagcctattctggagaaaatggatggcaccgaagagttattggtgaagcttaaccgtgaagacctcctgcggaaacagcgcacattcgataatggttcgatcccacaccaaatccatttgggggagttacacgctattttgcgtcgccaggaagacttttaccctttcctgaaggataaccgggagaaaattgagaagatccttacctttcgtattccgtattacgtaggccccttagcacggggtaatagccgtttcgcgtggatgacacggaagtcggaagagacgatcaccccgtggaacttcgaagaggtagtcgacaagggcgcatcagcgcagtcttttattgaacgtatgacgaatttcgataaaaacttgcccaatgagaaggtgcttccgaaacattccttgttatatgaatattttacagtttacaacgagctgaccaaggttaaatacgtgacggaaggaatgcgcaagcccgcttttcttagcggtgagcaaaaaaaggcgatcgtcgacctgttattcaaaacgaatcgtaaggtgactgtaaagcaactcaaagaagattacttcaaaaagattgagtgcttcgacagcgtcgaaatctctggggtagaggatcggtttaacgcaagtttaggtacctaccatgacctgcttaaaatcattaaggataaagacttcttagataatgaagagaacgaagatattctcgaggacatcgtcttgacgttaaccttatttgaggatcgtgaaatgattgaggaacgcctcaaaacttatgcccacctgttcgacgataaggtgatgaagcagctgaaacgtcggcgctacacaggatggggccgcttgagtcgcaaacttattaacggaatccgtgacaagcaatccggcaaaacgattctggatttcttgaagtcggacggatttgctaatcgcaacttcatgcagttgatccatgatgactccctgacttttaaagaggatattcaaaaggcgcaggttagtggtcaaggcgacagcttacacgaacacatcgcaaatttggctggttcgccggccattaaaaaggggatcctccagaccgtgaaagttgtagatgagcttgttaaggtcatgggtcgtcataagcccgaaaacatcgtgattgaaatggcgcgggagaatcaaacgacccagaaaggacaaaagaatagccgtgaacggatgaagcggatcgaggaaggcattaaagagctggggtctcaaatcttgaaggaacaccctgtggagaacactcagctccaaaatgaaaaactttacctgtactatttgcagaacggacgcgatatgtacgtggaccaagagttggatattaatcggctgagtgactacgacgttgatcatatcgtcccgcagagcttcctcaaagacgattctattgacaataaggtactgacgcgctctgataaaaaccgtggtaagtcggacaacgtgccctccgaagaggttgtgaaaaagatgaaaaattattggcgccagcttttaaacgcgaagctgatcacacaacgtaaattcgataatttgaccaaggctgaacggggtggcctgagcgagttagataaggcaggatttattaaacgccagttagtggagactcgtcaaatcaccaaacatgtcgcgcagattttggacagccggatgaacaccaagtacgatgaaaatgacaaactgatccgtgaggtgaaagtcattactctgaagtccaaattagttagtgatttccggaaggactttcaattctacaaagtccgtgaaattaataactatcatcacgcacatgacgcgtacctgaatgcagtggttgggaccgcccttatcaagaaatatcctaagctggagtcggagtttgtctatggcgactataaggtatacgatgttcgcaaaatgattgcgaaatctgagcaggagatcggtaaggcaaccgcaaaatatttcttttactcaaacattatgaatttctttaagacagaaatcactctggccaacggggagattcgcaaacgtccgttgatcgaaacaaacggcgagactggcgaaattgtttgggacaaagggcgtgatttcgcgacggtgcgcaaggtactgagcatgcctcaagtcaatattgttaagaaaaccgaagtgcagacgggcgggttttccaaggaaagcatcttacccaaacgtaattcagataaacttattgcacgcaaaaaggactgggatccgaaaaagtatggaggcttcgacagtccaaccgtagcctactctgttctcgttgtagcgaaagtagaaaagggtaaatccaagaaactgaaatctgtcaaggagttgcttggaatcaccattatggagcgtagctccttcgagaagaacccgattgactttctggaagccaaaggatataaagaggtcaagaaagatcttatcattaagctgcctaagtattcactcttcgagctggaaaatggtcgtaaacgcatgctcgcttctgccggcgagttgcagaagggcaatgaattagcacttccatcaaagtacgttaacttcctgtatttggccagccattacgagaaactgaaggggtctccagaggacaacgaacagaaacaattatttgtagagcagcacaagcattatcttgatgaaatcattgagcaaatttccgaattcagtaaacgcgtaatcctggccgatgcaaacctcgacaaggtgctgagcgcttacaataagcatcgcgacaaacctatccgtgagcaggctgaaaatatcattcacctgttcacattaacgaacctgggcgctccggccgcttttaaatatttcgacacgacaatcgaccgtaagcgctataccagtacgaaagaagtgttggatgcgacccttattcaccagtcaattacaggattatatgagacccgtatcgaccttagccaattaggtggggatgctcctgcgccagctcctgcacctgcgatggttagcaaaggtgaagaactgtttaccggcgttgtgccgattctggtggaactggatggtgatgtgaatggccataaatttagcgttagcggcgaaggcgaaggtgatgcgacctatggtaaactgaccctgaaatttatttgcaccaccggtaaactgccggttccgtggccgaccctggtgaccaccctgacctatggcgttcagtgctttagccgctatccggatcatatgaaacagcatgatttctttaaaagcgcgatgccggaaggctatgtgcaggaacgtaccatttttttcaaagatgatggcaactataaaacccgtgcggaagttaaatttgaaggcgataccctggtgaaccgcattgaactgaaaggtattgattttaaagaagatggcaacattctgggtcataaactggaatataattacaacagccataatgtgtatattatggccgataaacagaaaaatggcatcaaagtgaactttaaaatccgtcacaacattgaagatggtagcgtgcagctggcggatcattatcagcagaataccccgattggtgatggcccggtgctgctgccggataatcattatctgagcacccagagcgcgctgagcaaagatccgaatgaaaaacgtgatcatatggtgctgctggaatttgttaccgccgcgggcattaccctgggtatggatgaactgtataaa

SEQ ID NO: 358 - DNA, 4854 bp, Artificial Sequence
  SYNTHETIC
atggacaaaaagtactctattggcctggatatcgggaccaacagcgtcgggtgggctgttatcaccgacgagtataaagtaccttcgaaaaagttcaaagtgctgggcaacaccgatcgccattcaatcaaaaagaacttgattggtgcgctgttgtttgactccggggaaaccgccgaggcgactcgccttaaacgtacagcacgtcgccggtacactcggcgtaagaatcgcatttgctatttgcaggaaatctttagcaacgagatggcaaaagtcgatgactcgtttttccaccgcctcgaggaaagctttctggtggaggaagacaaaaagcatgagcgtcacccgatcttcggcaacattgtcgatgaagtagcgtatcatgaaaaatacccaaccatttaccacttacgcaaaaagctggtggacagcactgacaaagctgatttgcgccttatctatttagccctggcacatatgattaagtttcgtggtcacttcctgatcgaaggagacttaaatcccgacaacagtgatgttgataaattgtttattcagcttgtccaaacttacaatcaactgttcgaggaaaacccgatcaatgcctccggtgtggatgcaaaagccattttaagtgcacgccttagcaagtcccgtcgcttagaaaaccttatcgcgcagctgcccggcgagaaaaagaatggtttgtttgggaaccttattgccttgagcttaggcctcaccccgaatttcaaaagtaatttcgatcttgcagaagacgccaaattacaactgtcgaaggatacttatgatgacgatctcgataatctgttagcgcagattggtgaccaatacgccgatctttttctggcggctaaaaatctgagcgacgccatcttgctttcggatattctccgcgttaacaccgaaatcacgaaagcgcctcttagtgccagcatgattaaacgttatgatgaacaccaccaggacctgaccttactcaaagcgttggttcgccagcaactgccagagaagtacaaagaaatcttctttgatcagtcaaagaatggttatgccggctatattgacgggggtgcaagccaagaggaattctacaaatttatcaagcctattctggagaaaatggatggcaccgaagagttattggtgaagcttaaccgtgaagacctcctgcggaaacagcgcacattcgataatggttcgatcccacaccaaatccatttgggggagttacacgctattttgcgtcgccaggaagacttttaccctttcctgaaggataaccgggagaaaattgagaagatccttacctttcgtattccgtattacgtaggccccttagcacggggtaatagccgtttcgcgtggatgacacggaagtcggaagagacgatcaccccgtggaacttcgaagaggtagtcgacaagggcgcatcagcgcagtcttttattgaacgtatgacgaatttcgataaaaacttgcccaatgagaaggtgcttccgaaacattccttgttatatgaatattttacagtttacaacgagctgaccaaggttaaatacgtgacggaaggaatgcgcaagcccgcttttcttagcggtgagcaaaaaaaggcgatcgtcgacctgttattcaaaacgaatcgtaaggtgactgtaaagcaactcaaagaagattacttcaaaaagattgagtgcttcgacagcgtcgaaatctctggggtagaggatcggtttaacgcaagtttaggtacctaccatgacctgcttaaaatcattaaggataaagacttcttagataatgaagagaacgaagatattctcgaggacatcgtcttgacgttaaccttatttgaggatcgtgaaatgattgaggaacgcctcaaaacttatgcccacctgttcgacgataaggtgatgaagcagctgaaacgtcggcgctacacaggatggggccgcttgagtcgcaaacttattaacggaatccgtgacaagcaatccggcaaaacgattctggatttcttgaagtcggacggatttgctaatcgcaacttcatgcagttgatccatgatgactccctgacttttaaagaggatattcaaaaggcgcaggttagtggtcaaggcgacagcttacacgaacacatcgcaaatttggctggttcgccggccattaaaaaggggatcctccagaccgtgaaagttgtagatgagcttgttaaggtcatgggtcgtcataagcccgaaaacatcgtgattgaaatggcgcgggagaatcaaacgacccagaaaggacaaaagaatagccgtgaacggatgaagcggatcgaggaaggcattaaagagctggggtctcaaatcttgaaggaacaccctgtggagaacactcagctccaaaatgaaaaactttacctgtactatttgcagaacggacgcgatatgtacgtggaccaagagttggatattaatcggctgagtgactacgacgttgatcatatcgtcccgcagagcttcctcaaagacgattctattgacaataaggtactgacgcgctctgataaaaaccgtggtaagtcggacaacgtgccctccgaagaggttgtgaaaaagatgaaaaattattggcgccagcttttaaacgcgaagctgatcacacaacgtaaattcgataatttgaccaaggctgaacggggtggcctgagcgagttagataaggcaggatttattaaacgccagttagtggagactcgtcaaatcaccaaacatgtcgcgcagattttggacagccggatgaacaccaagtacgatgaaaatgacaaactgatccgtgaggtgaaagtcattactctgaagtccaaattagttagtgatttccggaaggactttcaattctacaaagtccgtgaaattaataactatcatcacgcacatgacgcgtacctgaatgcagtggttgggaccgcccttatcaagaaatatcctaagctggagtcggagtttgtctatggcgactataaggtatacgatgttcgcaaaatgattgcgaaatctgagcaggagatcggtaaggcaaccgcaaaatatttcttttactcaaacattatgaatttctttaagacagaaatcactctggccaacggggagattcgcaaacgtccgttgatcgaaacaaacggcgagactggcgaaattgtttgggacaaagggcgtgatttcgcgacggtgcgcaaggtactgagcatgcctcaagtcaatattgttaagaaaaccgaagtgcagacgggcgggttttccaaggaaagcatcttacccaaacgtaattcagataaacttattgcacgcaaaaaggactgggatccgaaaaagtatggaggcttcgacagtccaaccgtagcctactctgttctcgttgtagcgaaagtagaaaagggtaaatccaagaaactgaaatctgtcaaggagttgcttggaatcaccattatggagcgtagctccttcgagaagaacccgattgactttctggaagccaaaggatataaagaggtcaagaaagatcttatcattaagctgcctaagtattcactcttcgagctggaaaatggtcgtaaacgcatgctcgcttctgccggcgagttgcagaagggcaatgaattagcacttccatcaaagtacgttaacttcctgtatttggccagccattacgagaaactgaaggggtctccagaggacaacgaacagaaacaattatttgtagagcagcacaagcattatcttgatgaaatcattgagcaaatttccgaattcagtaaacgcgtaatcctggccgatgcaaacctcgacaaggtgctgagcgcttacaataagcatcgcgacaaacctatccgtgagcaggctgaaaatatcattcacctgttcacattaacgaacctgggcgctccggccgcttttaaatatttcgacacgacaatcgaccgtaagcgctataccagtacgaaagaagtgttggatgcgacccttattcaccagtcaattacaggattatatgagacccgtatcgaccttagccaattaggtggggatgcgcccgctcctgcgccagctcctgcacctgcgatggttagcaaaggtgaagaactgtttaccggcgttgtgccgattctggtggaactggatggtgatgtgaatggccataaatttagcgttagcggcgaaggcgaaggtgatgcgacctatggtaaactgaccctgaaatttatttgcaccaccggtaaactgccggttccgtggccgaccctggtgaccaccctgacctatggcgttcagtgctttagccgctatccggatcatatgaaacagcatgatttctttaaaagcgcgatgccggaaggctatgtgcaggaacgtaccatttttttcaaagatgatggcaactataaaacccgtgcggaagttaaatttgaaggcgataccctggtgaaccgcattgaactgaaaggtattgattttaaagaagatggcaacattctgggtcataaactggaatataattacaacagccataatgtgtatattatggccgataaacagaaaaatggcatcaaagtgaactttaaaatccgtcacaacattgaagatggtagcgtgcagctggcggatcattatcagcagaataccccgattggtgatggcccggtgctgctgccggataatcattatctgagcacccagagcgcgctgagcaaagatccgaatgaaaaacgtgatcatatggtgctgctggaatttgttaccgccgcgggcattaccctgggtatggatgaactgtataaa

SEQ ID NO: 359 - DNA, 4860 bp, Artificial Sequence
  SYNTHETIC
atggacaaaaagtactctattggcctggatatcgggaccaacagcgtcgggtgggctgttatcaccgacgagtataaagtaccttcgaaaaagttcaaagtgctgggcaacaccgatcgccattcaatcaaaaagaacttgattggtgcgctgttgtttgactccggggaaaccgccgaggcgactcgccttaaacgtacagcacgtcgccggtacactcggcgtaagaatcgcatttgctatttgcaggaaatctttagcaacgagatggcaaaagtcgatgactcgtttttccaccgcctcgaggaaagctttctggtggaggaagacaaaaagcatgagcgtcacccgatcttcggcaacattgtcgatgaagtagcgtatcatgaaaaatacccaaccatttaccacttacgcaaaaagctggtggacagcactgacaaagctgatttgcgccttatctatttagccctggcacatatgattaagtttcgtggtcacttcctgatcgaaggagacttaaatcccgacaacagtgatgttgataaattgtttattcagcttgtccaaacttacaatcaactgttcgaggaaaacccgatcaatgcctccggtgtggatgcaaaagccattttaagtgcacgccttagcaagtcccgtcgcttagaaaaccttatcgcgcagctgcccggcgagaaaaagaatggtttgtttgggaaccttattgccttgagcttaggcctcaccccgaatttcaaaagtaatttcgatcttgcagaagacgccaaattacaactgtcgaaggatacttatgatgacgatctcgataatctgttagcgcagattggtgaccaatacgccgatctttttctggcggctaaaaatctgagcgacgccatcttgctttcggatattctccgcgttaacaccgaaatcacgaaagcgcctcttagtgccagcatgattaaacgttatgatgaacaccaccaggacctgaccttactcaaagcgttggttcgccagcaactgccagagaagtacaaagaaatcttctttgatcagtcaaagaatggttatgccggctatattgacgggggtgcaagccaagaggaattctacaaatttatcaagcctattctggagaaaatggatggcaccgaagagttattggtgaagcttaaccgtgaagacctcctgcggaaacagcgcacattcgataatggttcgatcccacaccaaatccatttgggggagttacacgctattttgcgtcgccaggaagacttttaccctttcctgaaggataaccgggagaaaattgagaagatccttacctttcgtattccgtattacgtaggccccttagcacggggtaatagccgtttcgcgtggatgacacggaagtcggaagagacgatcaccccgtggaacttcgaagaggtagtcgacaagggcgcatcagcgcagtcttttattgaacgtatgacgaatttcgataaaaacttgcccaatgagaaggtgcttccgaaacattccttgttatatgaatattttacagtttacaacgagctgaccaaggttaaatacgtgacggaaggaatgcgcaagcccgcttttcttagcggtgagcaaaaaaaggcgatcgtcgacctgttattcaaaacgaatcgtaaggtgactgtaaagcaactcaaagaagattacttcaaaaagattgagtgcttcgacagcgtcgaaatctctggggtagaggatcggtttaacgcaagtttaggtacctaccatgacctgcttaaaatcattaaggataaagacttcttagataatgaagagaacgaagatattctcgaggacatcgtcttgacgttaaccttatttgaggatcgtgaaatgattgaggaacgcctcaaaacttatgcccacctgttcgacgataaggtgatgaagcagctgaaacgtcggcgctacacaggatggggccgcttgagtcgcaaacttattaacggaatccgtgacaagcaatccggcaaaacgattctggatttcttgaagtcggacggatttgctaatcgcaacttcatgcagttgatccatgatgactccctgacttttaaagaggatattcaaaaggcgcaggttagtggtcaaggcgacagcttacacgaacacatcgcaaatttggctggttcgccggccattaaaaaggggatcctccagaccgtgaaagttgtagatgagcttgttaaggtcatgggtcgtcataagcccgaaaacatcgtgattgaaatggcgcgggagaatcaaacgacccagaaaggacaaaagaatagccgtgaacggatgaagcggatcgaggaaggcattaaagagctggggtctcaaatcttgaaggaacaccctgtggagaacactcagctccaaaatgaaaaactttacctgtactatttgcagaacggacgcgatatgtacgtggaccaagagttggatattaatcggctgagtgactacgacgttgatcatatcgtcccgcagagcttcctcaaagacgattctattgacaataaggtactgacgcgctctgataaaaaccgtggtaagtcggacaacgtgccctccgaagaggttgtgaaaaagatgaaaaattattggcgccagcttttaaacgcgaagctgatcacacaacgtaaattcgataatttgaccaaggctgaacggggtggcctgagcgagttagataaggcaggatttattaaacgccagttagtggagactcgtcaaatcaccaaacatgtcgcgcagattttggacagccggatgaacaccaagtacgatgaaaatgacaaactgatccgtgaggtgaaagtcattactctgaagtccaaattagttagtgatttccggaaggactttcaattctacaaagtccgtgaaattaataactatcatcacgcacatgacgcgtacctgaatgcagtggttgggaccgcccttatcaagaaatatcctaagctggagtcggagtttgtctatggcgactataaggtatacgatgttcgcaaaatgattgcgaaatctgagcaggagatcggtaaggcaaccgcaaaatatttcttttactcaaacattatgaatttctttaagacagaaatcactctggccaacggggagattcgcaaacgtccgttgatcgaaacaaacggcgagactggcgaaattgtttgggacaaagggcgtgatttcgcgacggtgcgcaaggtactgagcatgcctcaagtcaatattgttaagaaaaccgaagtgcagacgggcgggttttccaaggaaagcatcttacccaaacgtaattcagataaacttattgcacgcaaaaaggactgggatccgaaaaagtatggaggcttcgacagtccaaccgtagcctactctgttctcgttgtagcgaaagtagaaaagggtaaatccaagaaactgaaatctgtcaaggagttgcttggaatcaccattatggagcgtagctccttcgagaagaacccgattgactttctggaagccaaaggatataaagaggtcaagaaagatcttatcattaagctgcctaagtattcactcttcgagctggaaaatggtcgtaaacgcatgctcgcttctgccggcgagttgcagaagggcaatgaattagcacttccatcaaagtacgttaacttcctgtatttggccagccattacgagaaactgaaggggtctccagaggacaacgaacagaaacaattatttgtagagcagcacaagcattatcttgatgaaatcattgagcaaatttccgaattcagtaaacgcgtaatcctggccgatgcaaacctcgacaaggtgctgagcgcttacaataagcatcgcgacaaacctatccgtgagcaggctgaaaatatcattcacctgttcacattaacgaacctgggcgctccggccgcttttaaatatttcgacacgacaatcgaccgtaagcgctataccagtacgaaagaagtgttggatgcgacccttattcaccagtcaattacaggattatatgagacccgtatcgaccttagccaattaggtggggatgcgccagcgcctgctcctgcacccgctccagcacctgcgatggttagcaaaggtgaagaactgtttaccggcgttgtgccgattctggtggaactggatggtgatgtgaatggccataaatttagcgttagcggcgaaggcgaaggtgatgcgacctatggtaaactgaccctgaaatttatttgcaccaccggtaaactgccggttccgtggccgaccctggtgaccaccctgacctatggcgttcagtgctttagccgctatccggatcatatgaaacagcatgatttctttaaaagcgcgatgccggaaggctatgtgcaggaacgtaccatttttttcaaagatgatggcaactataaaacccgtgcggaagttaaatttgaaggcgataccctggtgaaccgcattgaactgaaaggtattgattttaaagaagatggcaacattctgggtcataaactggaatataattacaacagccataatgtgtatattatggccgataaacagaaaaatggcatcaaagtgaactttaaaatccgtcacaacattgaagatggtagcgtgcagctggcggatcattatcagcagaataccccgattggtgatggcccggtgctgctgccggataatcattatctgagcacccagagcgcgctgagcaaagatccgaatgaaaaacgtgatcatatggtgctgctggaatttgttaccgccgcgggcattaccctgggtatggatgaactgtataaa

SEQ ID NO: 360 - DNA, 4866 bp, Artificial Sequence
  SYNTHETIC
atggacaaaaagtactctattggcctggatatcgggaccaacagcgtcgggtgggctgttatcaccgacgagtataaagtaccttcgaaaaagttcaaagtgctgggcaacaccgatcgccattcaatcaaaaagaacttgattggtgcgctgttgtttgactccggggaaaccgccgaggcgactcgccttaaacgtacagcacgtcgccggtacactcggcgtaagaatcgcatttgctatttgcaggaaatctttagcaacgagatggcaaaagtcgatgactcgtttttccaccgcctcgaggaaagctttctggtggaggaagacaaaaagcatgagcgtcacccgatcttcggcaacattgtcgatgaagtagcgtatcatgaaaaatacccaaccatttaccacttacgcaaaaagctggtggacagcactgacaaagctgatttgcgccttatctatttagccctggcacatatgattaagtttcgtggtcacttcctgatcgaaggagacttaaatcccgacaacagtgatgttgataaattgtttattcagcttgtccaaacttacaatcaactgttcgaggaaaacccgatcaatgcctccggtgtggatgcaaaagccattttaagtgcacgccttagcaagtcccgtcgcttagaaaaccttatcgcgcagctgcccggcgagaaaaagaatggtttgtttgggaaccttattgccttgagcttaggcctcaccccgaatttcaaaagtaatttcgatcttgcagaagacgccaaattacaactgtcgaaggatacttatgatgacgatctcgataatctgttagcgcagattggtgaccaatacgccgatctttttctggcggctaaaaatctgagcgacgccatcttgctttcggatattctccgcgttaacaccgaaatcacgaaagcgcctcttagtgccagcatgattaaacgttatgatgaacaccaccaggacctgaccttactcaaagcgttggttcgccagcaactgccagagaagtacaaagaaatcttctttgatcagtcaaagaatggttatgccggctatattgacgggggtgcaagccaagaggaattctacaaatttatcaagcctattctggagaaaatggatggcaccgaagagttattggtgaagcttaaccgtgaagacctcctgcggaaacagcgcacattcgataatggttcgatcccacaccaaatccatttgggggagttacacgctattttgcgtcgccaggaagacttttaccctttcctgaaggataaccgggagaaaattgagaagatccttacctttcgtattccgtattacgtaggccccttagcacggggtaatagccgtttcgcgtggatgacacggaagtcggaagagacgatcaccccgtggaacttcgaagaggtagtcgacaagggcgcatcagcgcagtcttttattgaacgtatgacgaatttcgataaaaacttgcccaatgagaaggtgcttccgaaacattccttgttatatgaatattttacagtttacaacgagctgaccaaggttaaatacgtgacggaaggaatgcgcaagcccgcttttcttagcggtgagcaaaaaaaggcgatcgtcgacctgttattcaaaacgaatcgtaaggtgactgtaaagcaactcaaagaagattacttcaaaaagattgagtgcttcgacagcgtcgaaatctctggggtagaggatcggtttaacgcaagtttaggtacctaccatgacctgcttaaaatcattaaggataaagacttcttagataatgaagagaacgaagatattctcgaggacatcgtcttgacgttaaccttatttgaggatcgtgaaatgattgaggaacgcctcaaaacttatgcccacctgttcgacgataaggtgatgaagcagctgaaacgtcggcgctacacaggatggggccgcttgagtcgcaaacttattaacggaatccgtgacaagcaatccggcaaaacgattctggatttcttgaagtcggacggatttgctaatcgcaacttcatgcagttgatccatgatgactccctgacttttaaagaggatattcaaaaggcgcaggttagtggtcaaggcgacagcttacacgaacacatcgcaaatttggctggttcgccggccattaaaaaggggatcctccagaccgtgaaagttgtagatgagcttgttaaggtcatgggtcgtcataagcccgaaaacatcgtgattgaaatggcgcgggagaatcaaacgacccagaaaggacaaaagaatagccgtgaacggatgaagcggatcgaggaaggcattaaagagctggggtctcaaatcttgaaggaacaccctgtggagaacactcagctccaaaatgaaaaactttacctgtactatttgcagaacggacgcgatatgtacgtggaccaagagttggatattaatcggctgagtgactacgacgttgatcatatcgtcccgcagagcttcctcaaagacgattctattgacaataaggtactgacgcgctctgataaaaaccgtggtaagtcggacaacgtgccctccgaagaggttgtgaaaaagatgaaaaattattggcgccagcttttaaacgcgaagctgatcacacaacgtaaattcgataatttgaccaaggctgaacggggtggcctgagcgagttagataaggcaggatttattaaacgccagttagtggagactcgtcaaatcaccaaacatgtcgcgcagattttggacagccggatgaacaccaagtacgatgaaaatgacaaactgatccgtgaggtgaaagtcattactctgaagtccaaattagttagtgatttccggaaggactttcaattctacaaagtccgtgaaattaataactatcatcacgcacatgacgcgtacctgaatgcagtggttgggaccgcccttatcaagaaatatcctaagctggagtcggagtttgtctatggcgactataaggtatacgatgttcgcaaaatgattgcgaaatctgagcaggagatcggtaaggcaaccgcaaaatatttcttttactcaaacattatgaatttctttaagacagaaatcactctggccaacggggagattcgcaaacgtccgttgatcgaaacaaacggcgagactggcgaaattgtttgggacaaagggcgtgatttcgcgacggtgcgcaaggtactgagcatgcctcaagtcaatattgttaagaaaaccgaagtgcagacgggcgggttttccaaggaaagcatcttacccaaacgtaattcagataaacttattgcacgcaaaaaggactgggatccgaaaaagtatggaggcttcgacagtccaaccgtagcctactctgttctcgttgtagcgaaagtagaaaagggtaaatccaagaaactgaaatctgtcaaggagttgcttggaatcaccattatggagcgtagctccttcgagaagaacccgattgactttctggaagccaaaggatataaagaggtcaagaaagatcttatcattaagctgcctaagtattcactcttcgagctggaaaatggtcgtaaacgcatgctcgcttctgccggcgagttgcagaagggcaatgaattagcacttccatcaaagtacgttaacttcctgtatttggccagccattacgagaaactgaaggggtctccagaggacaacgaacagaaacaattatttgtagagcagcacaagcattatcttgatgaaatcattgagcaaatttccgaattcagtaaacgcgtaatcctggccgatgcaaacctcgacaaggtgctgagcgcttacaataagcatcgcgacaaacctatccgtgagcaggctgaaaatatcattcacctgttcacattaacgaacctgggcgctccggccgcttttaaatatttcgacacgacaatcgaccgtaagcgctataccagtacgaaagaagtgttggatgcgacccttattcaccagtcaattacaggattatatgagacccgtatcgaccttagccaattaggtggggatgcgccagcgcctgctcctgcacccgctccagctcctgccccagcgatggttagcaaaggtgaagaactgtttaccggcgttgtgccgattctggtggaactggatggtgatgtgaatggccataaatttagcgttagcggcgaaggcgaaggtgatgcgacctatggtaaactgaccctgaaatttatttgcaccaccggtaaactgccggttccgtggccgaccctggtgaccaccctgacctatggcgttcagtgctttagccgctatccggatcatatgaaacagcatgatttctttaaaagcgcgatgccggaaggctatgtgcaggaacgtaccatttttttcaaagatgatggcaactataaaacccgtgcggaagttaaatttgaaggcgataccctggtgaaccgcattgaactgaaaggtattgattttaaagaagatggcaacattctgggtcataaactggaatataattacaacagccataatgtgtatattatggccgataaacagaaaaatggcatcaaagtgaactttaaaatccgtcacaacattgaagatggtagcgtgcagctggcggatcattatcagcagaataccccgattggtgatggcccggtgctgctgccggataatcattatctgagcacccagagcgcgctgagcaaagatccgaatgaaaaacgtgatcatatggtgctgctggaatttgttaccgccgcgggcattaccctgggtatggatgaactgtataaa

SEQ ID NO: 361 - DNA, 4872 bp, Artificial Sequence
  SYNTHETIC
atggacaaaaagtactctattggcctggatatcgggaccaacagcgtcgggtgggctgttatcaccgacgagtataaagtaccttcgaaaaagttcaaagtgctgggcaacaccgatcgccattcaatcaaaaagaacttgattggtgcgctgttgtttgactccggggaaaccgccgaggcgactcgccttaaacgtacagcacgtcgccggtacactcggcgtaagaatcgcatttgctatttgcaggaaatctttagcaacgagatggcaaaagtcgatgactcgtttttccaccgcctcgaggaaagctttctggtggaggaagacaaaaagcatgagcgtcacccgatcttcggcaacattgtcgatgaagtagcgtatcatgaaaaatacccaaccatttaccacttacgcaaaaagctggtggacagcactgacaaagctgatttgcgccttatctatttagccctggcacatatgattaagtttcgtggtcacttcctgatcgaaggagacttaaatcccgacaacagtgatgttgataaattgtttattcagcttgtccaaacttacaatcaactgttcgaggaaaacccgatcaatgcctccggtgtggatgcaaaagccattttaagtgcacgccttagcaagtcccgtcgcttagaaaaccttatcgcgcagctgcccggcgagaaaaagaatggtttgtttgggaaccttattgccttgagcttaggcctcaccccgaatttcaaaagtaatttcgatcttgcagaagacgccaaattacaactgtcgaaggatacttatgatgacgatctcgataatctgttagcgcagattggtgaccaatacgccgatctttttctggcggctaaaaatctgagcgacgccatcttgctttcggatattctccgcgttaacaccgaaatcacgaaagcgcctcttagtgccagcatgattaaacgttatgatgaacaccaccaggacctgaccttactcaaagcgttggttcgccagcaactgccagagaagtacaaagaaatcttctttgatcagtcaaagaatggttatgccggctatattgacgggggtgcaagccaagaggaattctacaaatttatcaagcctattctggagaaaatggatggcaccgaagagttattggtgaagcttaaccgtgaagacctcctgcggaaacagcgcacattcgataatggttcgatcccacaccaaatccatttgggggagttacacgctattttgcgtcgccaggaagacttttaccctttcctgaaggataaccgggagaaaattgagaagatccttacctttcgtattccgtattacgtaggccccttagcacggggtaatagccgtttcgcgtggatgacacggaagtcggaagagacgatcaccccgtggaacttcgaagaggtagtcgacaagggcgcatcagcgcagtcttttattgaacgtatgacgaatttcgataaaaacttgcccaatgagaaggtgcttccgaaacattccttgttatatgaatattttacagtttacaacgagctgaccaaggttaaatacgtgacggaaggaatgcgcaagcccgcttttcttagcggtgagcaaaaaaaggcgatcgtcgacctgttattcaaaacgaatcgtaaggtgactgtaaagcaactcaaagaagattacttcaaaaagattgagtgcttcgacagcgtcgaaatctctggggtagaggatcggtttaacgcaagtttaggtacctaccatgacctgcttaaaatcattaaggataaagacttcttagataatgaagagaacgaagatattctcgaggacatcgtcttgacgttaaccttatttgaggatcgtgaaatgattgaggaacgcctcaaaacttatgcccacctgttcgacgataaggtgatgaagcagctgaaacgtcggcgctacacaggatggggccgcttgagtcgcaaacttattaacggaatccgtgacaagcaatccggcaaaacgattctggatttcttgaagtcggacggatttgctaatcgcaacttcatgcagttgatccatgatgactccctgacttttaaagaggatattcaaaaggcgcaggttagtggtcaaggcgacagcttacacgaacacatcgcaaatttggctggttcgccggccattaaaaaggggatcctccagaccgtgaaagttgtagatgagcttgttaaggtcatgggtcgtcataagcccgaaaacatcgtgattgaaatggcgcgggagaatcaaacgacccagaaaggacaaaagaatagccgtgaacggatgaagcggatcgaggaaggcattaaagagctggggtctcaaatcttgaaggaacaccctgtggagaacactcagctccaaaatgaaaaactttacctgtactatttgcagaacggacgcgatatgtacgtggaccaagagttggatattaatcggctgagtgactacgacgttgatcatatcgtcccgcagagcttcctcaaagacgattctattgacaataaggtactgacgcgctctgataaaaaccgtggtaagtcggacaacgtgccctccgaagaggttgtgaaaaagatgaaaaattattggcgccagcttttaaacgcgaagctgatcacacaacgtaaattcgataatttgaccaaggctgaacggggtggcctgagcgagttagataaggcaggatttattaaacgccagttagtggagactcgtcaaatcaccaaacatgtcgcgcagattttggacagccggatgaacaccaagtacgatgaaaatgacaaactgatccgtgaggtgaaagtcattactctgaagtccaaattagttagtgatttccggaaggactttcaattctacaaagtccgtgaaattaataactatcatcacgcacatgacgcgtacctgaatgcagtggttgggaccgcccttatcaagaaatatcctaagctggagtcggagtttgtctatggcgactataaggtatacgatgttcgcaaaatgattgcgaaatctgagcaggagatcggtaaggcaaccgcaaaatatttcttttactcaaacattatgaatttctttaagacagaaatcactctggccaacggggagattcgcaaacgtccgttgatcgaaacaaacggcgagactggcgaaattgtttgggacaaagggcgtgatttcgcgacggtgcgcaaggtactgagcatgcctcaagtcaatattgttaagaaaaccgaagtgcagacgggcgggttttccaaggaaagcatcttacccaaacgtaattcagataaacttattgcacgcaaaaaggactgggatccgaaaaagtatggaggcttcgacagtccaaccgtagcctactctgttctcgttgtagcgaaagtagaaaagggtaaatccaagaaactgaaatctgtcaaggagttgcttggaatcaccattatggagcgtagctccttcgagaagaacccgattgactttctggaagccaaaggatataaagaggtcaagaaagatcttatcattaagctgcctaagtattcactcttcgagctggaaaatggtcgtaaacgcatgctcgcttctgccggcgagttgcagaagggcaatgaattagcacttccatcaaagtacgttaacttcctgtatttggccagccattacgagaaactgaaggggtctccagaggacaacgaacagaaacaattatttgtagagcagcacaagcattatcttgatgaaatcattgagcaaatttccgaattcagtaaacgcgtaatcctggccgatgcaaacctcgacaaggtgctgagcgcttacaataagcatcgcgacaaacctatccgtgagcaggctgaaaatatcattcacctgttcacattaacgaacctgggcgctccggccgcttttaaatatttcgacacgacaatcgaccgtaagcgctataccagtacgaaagaagtgttggatgcgacccttattcaccagtcaattacaggattatatgagacccgtatcgaccttagccaattaggtggggatgcgccagcgcctgctcctgcacccgctccagcgccagctcctgcacctgcgatggttagcaaaggtgaagaactgtttaccggcgttgtgccgattctggtggaactggatggtgatgtgaatggccataaatttagcgttagcggcgaaggcgaaggtgatgcgacctatggtaaactgaccctgaaatttatttgcaccaccggtaaactgccggttccgtggccgaccctggtgaccaccctgacctatggcgttcagtgctttagccgctatccggatcatatgaaacagcatgatttctttaaaagcgcgatgccggaaggctatgtgcaggaacgtaccatttttttcaaagatgatggcaactataaaacccgtgcggaagttaaatttgaaggcgataccctggtgaaccgcattgaactgaaaggtattgattttaaagaagatggcaacattctgggtcataaactggaatataattacaacagccataatgtgtatattatggccgataaacagaaaaatggcatcaaagtgaactttaaaatccgtcacaacattgaagatggtagcgtgcagctggcggatcattatcagcagaataccccgattggtgatggcccggtgctgctgccggataatcattatctgagcacccagagcgcgctgagcaaagatccgaatgaaaaacgtgatcatatggtgctgctggaatttgttaccgccgcgggcattaccctgggtatggatgaactgtataaa

SEQ ID NO: 362 - DNA, 4878 bp, Artificial Sequence
  SYNTHETIC
atggacaaaaagtactctattggcctggatatcgggaccaacagcgtcgggtgggctgttatcaccgacgagtataaagtaccttcgaaaaagttcaaagtgctgggcaacaccgatcgccattcaatcaaaaagaacttgattggtgcgctgttgtttgactccggggaaaccgccgaggcgactcgccttaaacgtacagcacgtcgccggtacactcggcgtaagaatcgcatttgctatttgcaggaaatctttagcaacgagatggcaaaagtcgatgactcgtttttccaccgcctcgaggaaagctttctggtggaggaagacaaaaagcatgagcgtcacccgatcttcggcaacattgtcgatgaagtagcgtatcatgaaaaatacccaaccatttaccacttacgcaaaaagctggtggacagcactgacaaagctgatttgcgccttatctatttagccctggcacatatgattaagtttcgtggtcacttcctgatcgaaggagacttaaatcccgacaacagtgatgttgataaattgtttattcagcttgtccaaacttacaatcaactgttcgaggaaaacccgatcaatgcctccggtgtggatgcaaaagccattttaagtgcacgccttagcaagtcccgtcgcttagaaaaccttatcgcgcagctgcccggcgagaaaaagaatggtttgtttgggaaccttattgccttgagcttaggcctcaccccgaatttcaaaagtaatttcgatcttgcagaagacgccaaattacaactgtcgaaggatacttatgatgacgatctcgataatctgttagcgcagattggtgaccaatacgccgatctttttctggcggctaaaaatctgagcgacgccatcttgctttcggatattctccgcgttaacaccgaaatcacgaaagcgcctcttagtgccagcatgattaaacgttatgatgaacaccaccaggacctgaccttactcaaagcgttggttcgccagcaactgccagagaagtacaaagaaatcttctttgatcagtcaaagaatggttatgccggctatattgacgggggtgcaagccaagaggaattctacaaatttatcaagcctattctggagaaaatggatggcaccgaagagttattggtgaagcttaaccgtgaagacctcctgcggaaacagcgcacattcgataatggttcgatcccacaccaaatccatttgggggagttacacgctattttgcgtcgccaggaagacttttaccctttcctgaaggataaccgggagaaaattgagaagatccttacctttcgtattccgtattacgtaggccccttagcacggggtaatagccgtttcgcgtggatgacacggaagtcggaagagacgatcaccccgtggaacttcgaagaggtagtcgacaagggcgcatcagcgcagtcttttattgaacgtatgacgaatttcgataaaaacttgcccaatgagaaggtgcttccgaaacattccttgttatatgaatattttacagtttacaacgagctgaccaaggttaaatacgtgacggaaggaatgcgcaagcccgcttttcttagcggtgagcaaaaaaaggcgatcgtcgacctgttattcaaaacgaatcgtaaggtgactgtaaagcaactcaaagaagattacttcaaaaagattgagtgcttcgacagcgtcgaaatctctggggtagaggatcggtttaacgcaagtttaggtacctaccatgacctgcttaaaatcattaaggataaagacttcttagataatgaagagaacgaagatattctcgaggacatcgtcttgacgttaaccttatttgaggatcgtgaaatgattgaggaacgcctcaaaacttatgcccacctgttcgacgataaggtgatgaagcagctgaaacgtcggcgctacacaggatggggccgcttgagtcgcaaacttattaacggaatccgtgacaagcaatccggcaaaacgattctggatttcttgaagtcggacggatttgctaatcgcaacttcatgcagttgatccatgatgactccctgacttttaaagaggatattcaaaaggcgcaggttagtggtcaaggcgacagcttacacgaacacatcgcaaatttggctggttcgccggccattaaaaaggggatcctccagaccgtgaaagttgtagatgagcttgttaaggtcatgggtcgtcataagcccgaaaacatcgtgattgaaatggcgcgggagaatcaaacgacccagaaaggacaaaagaatagccgtgaacggatgaagcggatcgaggaaggcattaaagagctggggtctcaaatcttgaaggaacaccctgtggagaacactcagctccaaaatgaaaaactttacctgtactatttgcagaacggacgcgatatgtacgtggaccaagagttggatattaatcggctgagtgactacgacgttgatcatatcgtcccgcagagcttcctcaaagacgattctattgacaataaggtactgacgcgctctgataaaaaccgtggtaagtcggacaacgtgccctccgaagaggttgtgaaaaagatgaaaaattattggcgccagcttttaaacgcgaagctgatcacacaacgtaaattcgataatttgaccaaggctgaacggggtggcctgagcgagttagataaggcaggatttattaaacgccagttagtggagactcgtcaaatcaccaaacatgtcgcgcagattttggacagccggatgaacaccaagtacgatgaaaatgacaaactgatccgtgaggtgaaagtcattactctgaagtccaaattagttagtgatttccggaaggactttcaattctacaaagtccgtgaaattaataactatcatcacgcacatgacgcgtacctgaatgcagtggttgggaccgcccttatcaagaaatatcctaagctggagtcggagtttgtctatggcgactataaggtatacgatgttcgcaaaatgattgcgaaatctgagcaggagatcggtaaggcaaccgcaaaatatttcttttactcaaacattatgaatttctttaagacagaaatcactctggccaacggggagattcgcaaacgtccgttgatcgaaacaaacggcgagactggcgaaattgtttgggacaaagggcgtgatttcgcgacggtgcgcaaggtactgagcatgcctcaagtcaatattgttaagaaaaccgaagtgcagacgggcgggttttccaaggaaagcatcttacccaaacgtaattcagataaacttattgcacgcaaaaaggactgggatccgaaaaagtatggaggcttcgacagtccaaccgtagcctactctgttctcgttgtagcgaaagtagaaaagggtaaatccaagaaactgaaatctgtcaaggagttgcttggaatcaccattatggagcgtagctccttcgagaagaacccgattgactttctggaagccaaaggatataaagaggtcaagaaagatcttatcattaagctgcctaagtattcactcttcgagctggaaaatggtcgtaaacgcatgctcgcttctgccggcgagttgcagaagggcaatgaattagcacttccatcaaagtacgttaacttcctgtatttggccagccattacgagaaactgaaggggtctccagaggacaacgaacagaaacaattatttgtagagcagcacaagcattatcttgatgaaatcattgagcaaatttccgaattcagtaaacgcgtaatcctggccgatgcaaacctcgacaaggtgctgagcgcttacaataagcatcgcgacaaacctatccgtgagcaggctgaaaatatcattcacctgttcacattaacgaacctgggcgctccggccgcttttaaatatttcgacacgacaatcgaccgtaagcgctataccagtacgaaagaagtgttggatgcgacccttattcaccagtcaattacaggattatatgagacccgtatcgaccttagccaattaggtggggatgcgccagcgcctgctcctgcacccgctccagctcctgcgccagctcctgcacctgcgatggttagcaaaggtgaagaactgtttaccggcgttgtgccgattctggtggaactggatggtgatgtgaatggccataaatttagcgttagcggcgaaggcgaaggtgatgcgacctatggtaaactgaccctgaaatttatttgcaccaccggtaaactgccggttccgtggccgaccctggtgaccaccctgacctatggcgttcagtgctttagccgctatccggatcatatgaaacagcatgatttctttaaaagcgcgatgccggaaggctatgtgcaggaacgtaccatttttttcaaagatgatggcaactataaaacccgtgcggaagttaaatttgaaggcgataccctggtgaaccgcattgaactgaaaggtattgattttaaagaagatggcaacattctgggtcataaactggaatataattacaacagccataatgtgtatattatggccgataaacagaaaaatggcatcaaagtgaactttaaaatccgtcacaacattgaagatggtagcgtgcagctggcggatcattatcagcagaataccccgattggtgatggcccggtgctgctgccggataatcattatctgagcacccagagcgcgctgagcaaagatccgaatgaaaaacgtgatcatatggtgctgctggaatttgttaccgccgcgggcattaccctgggtatggatgaactgtataaa

SEQ ID NO: 363 - DNA, 4884 bp, Artificial Sequence
  SYNTHETIC
atggacaaaaagtactctattggcctggatatcgggaccaacagcgtcgggtgggctgttatcaccgacgagtataaagtaccttcgaaaaagttcaaagtgctgggcaacaccgatcgccattcaatcaaaaagaacttgattggtgcgctgttgtttgactccggggaaaccgccgaggcgactcgccttaaacgtacagcacgtcgccggtacactcggcgtaagaatcgcatttgctatttgcaggaaatctttagcaacgagatggcaaaagtcgatgactcgtttttccaccgcctcgaggaaagctttctggtggaggaagacaaaaagcatgagcgtcacccgatcttcggcaacattgtcgatgaagtagcgtatcatgaaaaatacccaaccatttaccacttacgcaaaaagctggtggacagcactgacaaagctgatttgcgccttatctatttagccctggcacatatgattaagtttcgtggtcacttcctgatcgaaggagacttaaatcccgacaacagtgatgttgataaattgtttattcagcttgtccaaacttacaatcaactgttcgaggaaaacccgatcaatgcctccggtgtggatgcaaaagccattttaagtgcacgccttagcaagtcccgtcgcttagaaaaccttatcgcgcagctgcccggcgagaaaaagaatggtttgtttgggaaccttattgccttgagcttaggcctcaccccgaatttcaaaagtaatttcgatcttgcagaagacgccaaattacaactgtcgaaggatacttatgatgacgatctcgataatctgttagcgcagattggtgaccaatacgccgatctttttctggcggctaaaaatctgagcgacgccatcttgctttcggatattctccgcgttaacaccgaaatcacgaaagcgcctcttagtgccagcatgattaaacgttatgatgaacaccaccaggacctgaccttactcaaagcgttggttcgccagcaactgccagagaagtacaaagaaatcttctttgatcagtcaaagaatggttatgccggctatattgacgggggtgcaagccaagaggaattctacaaatttatcaagcctattctggagaaaatggatggcaccgaagagttattggtgaagcttaaccgtgaagacctcctgcggaaacagcgcacattcgataatggttcgatcccacaccaaatccatttgggggagttacacgctattttgcgtcgccaggaagacttttaccctttcctgaaggataaccgggagaaaattgagaagatccttacctttcgtattccgtattacgtaggccccttagcacggggtaatagccgtttcgcgtggatgacacggaagtcggaagagacgatcaccccgtggaacttcgaagaggtagtcgacaagggcgcatcagcgcagtcttttattgaacgtatgacgaatttcgataaaaacttgcccaatgagaaggtgcttccgaaacattccttgttatatgaatattttacagtttacaacgagctgaccaaggttaaatacgtgacggaaggaatgcgcaagcccgcttttcttagcggtgagcaaaaaaaggcgatcgtcgacctgttattcaaaacgaatcgtaaggtgactgtaaagcaactcaaagaagattacttcaaaaagattgagtgcttcgacagcgtcgaaatctctggggtagaggatcggtttaacgcaagtttaggtacctaccatgacctgcttaaaatcattaaggataaagacttcttagataatgaagagaacgaagatattctcgaggacatcgtcttgacgttaaccttatttgaggatcgtgaaatgattgaggaacgcctcaaaacttatgcccacctgttcgacgataaggtgatgaagcagctgaaacgtcggcgctacacaggatggggccgcttgagtcgcaaacttattaacggaatccgtgacaagcaatccggcaaaacgattctggatttcttgaagtcggacggatttgctaatcgcaacttcatgcagttgatccatgatgactccctgacttttaaagaggatattcaaaaggcgcaggttagtggtcaaggcgacagcttacacgaacacatcgcaaatttggctggttcgccggccattaaaaaggggatcctccagaccgtgaaagttgtagatgagcttgttaaggtcatgggtcgtcataagcccgaaaacatcgtgattgaaatggcgcgggagaatcaaacgacccagaaaggacaaaagaatagccgtgaacggatgaagcggatcgaggaaggcattaaagagctggggtctcaaatcttgaaggaacaccctgtggagaacactcagctccaaaatgaaaaactttacctgtactatttgcagaacggacgcgatatgtacgtggaccaagagttggatattaatcggctgagtgactacgacgttgatcatatcgtcccgcagagcttcctcaaagacgattctattgacaataaggtactgacgcgctctgataaaaaccgtggtaagtcggacaacgtgccctccgaagaggttgtgaaaaagatgaaaaattattggcgccagcttttaaacgcgaagctgatcacacaacgtaaattcgataatttgaccaaggctgaacggggtggcctgagcgagttagataaggcaggatttattaaacgccagttagtggagactcgtcaaatcaccaaacatgtcgcgcagattttggacagccggatgaacaccaagtacgatgaaaatgacaaactgatccgtgaggtgaaagtcattactctgaagtccaaattagttagtgatttccggaaggactttcaattctacaaagtccgtgaaattaataactatcatcacgcacatgacgcgtacctgaatgcagtggttgggaccgcccttatcaagaaatatcctaagctggagtcggagtttgtctatggcgactataaggtatacgatgttcgcaaaatgattgcgaaatctgagcaggagatcggtaaggcaaccgcaaaatatttcttttactcaaacattatgaatttctttaagacagaaatcactctggccaacggggagattcgcaaacgtccgttgatcgaaacaaacggcgagactggcgaaattgtttgggacaaagggcgtgatttcgcgacggtgcgcaaggtactgagcatgcctcaagtcaatattgttaagaaaaccgaagtgcagacgggcgggttttccaaggaaagcatcttacccaaacgtaattcagataaacttattgcacgcaaaaaggactgggatccgaaaaagtatggaggcttcgacagtccaaccgtagcctactctgttctcgttgtagcgaaagtagaaaagggtaaatccaagaaactgaaatctgtcaaggagttgcttggaatcaccattatggagcgtagctccttcgagaagaacccgattgactttctggaagccaaaggatataaagaggtcaagaaagatcttatcattaagctgcctaagtattcactcttcgagctggaaaatggtcgtaaacgcatgctcgcttctgccggcgagttgcagaagggcaatgaattagcacttccatcaaagtacgttaacttcctgtatttggccagccattacgagaaactgaaggggtctccagaggacaacgaacagaaacaattatttgtagagcagcacaagcattatcttgatgaaatcattgagcaaatttccgaattcagtaaacgcgtaatcctggccgatgcaaacctcgacaaggtgctgagcgcttacaataagcatcgcgacaaacctatccgtgagcaggctgaaaatatcattcacctgttcacattaacgaacctgggcgctccggccgcttttaaatatttcgacacgacaatcgaccgtaagcgctataccagtacgaaagaagtgttggatgcgacccttattcaccagtcaattacaggattatatgagacccgtatcgaccttagccaattaggtggggatgcgccagcgcctgctcctgcacccgctccagctcctgctcctgcgccagctcctgcacctgcgatggttagcaaaggtgaagaactgtttaccggcgttgtgccgattctggtggaactggatggtgatgtgaatggccataaatttagcgttagcggcgaaggcgaaggtgatgcgacctatggtaaactgaccctgaaatttatttgcaccaccggtaaactgccggttccgtggccgaccctggtgaccaccctgacctatggcgttcagtgctttagccgctatccggatcatatgaaacagcatgatttctttaaaagcgcgatgccggaaggctatgtgcaggaacgtaccatttttttcaaagatgatggcaactataaaacccgtgcggaagttaaatttgaaggcgataccctggtgaaccgcattgaactgaaaggtattgattttaaagaagatggcaacattctgggtcataaactggaatataattacaacagccataatgtgtatattatggccgataaacagaaaaatggcatcaaagtgaactttaaaatccgtcacaacattgaagatggtagcgtgcagctggcggatcattatcagcagaataccccgattggtgatggcccggtgctgctgccggataatcattatctgagcacccagagcgcgctgagcaaagatccgaatgaaaaacgtgatcatatggtgctgctggaatttgttaccgccgcgggcattaccctgggtatggatgaactgtataaa

SEQ ID NO: 364 - DNA, 4890 bp, Artificial Sequence
  SYNTHETIC
atggacaaaaagtactctattggcctggatatcgggaccaacagcgtcgggtgggctgttatcaccgacgagtataaagtaccttcgaaaaagttcaaagtgctgggcaacaccgatcgccattcaatcaaaaagaacttgattggtgcgctgttgtttgactccggggaaaccgccgaggcgactcgccttaaacgtacagcacgtcgccggtacactcggcgtaagaatcgcatttgctatttgcaggaaatctttagcaacgagatggcaaaagtcgatgactcgtttttccaccgcctcgaggaaagctttctggtggaggaagacaaaaagcatgagcgtcacccgatcttcggcaacattgtcgatgaagtagcgtatcatgaaaaatacccaaccatttaccacttacgcaaaaagctggtggacagcactgacaaagctgatttgcgccttatctatttagccctggcacatatgattaagtttcgtggtcacttcctgatcgaaggagacttaaatcccgacaacagtgatgttgataaattgtttattcagcttgtccaaacttacaatcaactgttcgaggaaaacccgatcaatgcctccggtgtggatgcaaaagccattttaagtgcacgccttagcaagtcccgtcgcttagaaaaccttatcgcgcagctgcccggcgagaaaaagaatggtttgtttgggaaccttattgccttgagcttaggcctcaccccgaatttcaaaagtaatttcgatcttgcagaagacgccaaattacaactgtcgaaggatacttatgatgacgatctcgataatctgttagcgcagattggtgaccaatacgccgatctttttctggcggctaaaaatctgagcgacgccatcttgctttcggatattctccgcgttaacaccgaaatcacgaaagcgcctcttagtgccagcatgattaaacgttatgatgaacaccaccaggacctgaccttactcaaagcgttggttcgccagcaactgccagagaagtacaaagaaatcttctttgatcagtcaaagaatggttatgccggctatattgacgggggtgcaagccaagaggaattctacaaatttatcaagcctattctggagaaaatggatggcaccgaagagttattggtgaagcttaaccgtgaagacctcctgcggaaacagcgcacattcgataatggttcgatcccacaccaaatccatttgggggagttacacgctattttgcgtcgccaggaagacttttaccctttcctgaaggataaccgggagaaaattgagaagatccttacctttcgtattccgtattacgtaggccccttagcacggggtaatagccgtttcgcgtggatgacacggaagtcggaagagacgatcaccccgtggaacttcgaagaggtagtcgacaagggcgcatcagcgcagtcttttattgaacgtatgacgaatttcgataaaaacttgcccaatgagaaggtgcttccgaaacattccttgttatatgaatattttacagtttacaacgagctgaccaaggttaaatacgtgacggaaggaatgcgcaagcccgcttttcttagcggtgagcaaaaaaaggcgatcgtcgacctgttattcaaaacgaatcgtaaggtgactgtaaagcaactcaaagaagattacttcaaaaagattgagtgcttcgacagcgtcgaaatctctggggtagaggatcggtttaacgcaagtttaggtacctaccatgacctgcttaaaatcattaaggataaagacttcttagataatgaagagaacgaagatattctcgaggacatcgtcttgacgttaaccttatttgaggatcgtgaaatgattgaggaacgcctcaaaacttatgcccacctgttcgacgataaggtgatgaagcagctgaaacgtcggcgctacacaggatggggccgcttgagtcgcaaacttattaacggaatccgtgacaagcaatccggcaaaacgattctggatttcttgaagtcggacggatttgctaatcgcaacttcatgcagttgatccatgatgactccctgacttttaaagaggatattcaaaaggcgcaggttagtggtcaaggcgacagcttacacgaacacatcgcaaatttggctggttcgccggccattaaaaaggggatcctccagaccgtgaaagttgtagatgagcttgttaaggtcatgggtcgtcataagcccgaaaacatcgtgattgaaatggcgcgggagaatcaaacgacccagaaaggacaaaagaatagccgtgaacggatgaagcggatcgaggaaggcattaaagagctggggtctcaaatcttgaaggaacaccctgtggagaacactcagctccaaaatgaaaaactttacctgtactatttgcagaacggacgcgatatgtacgtggaccaagagttggatattaatcggctgagtgactacgacgttgatcatatcgtcccgcagagcttcctcaaagacgattctattgacaataaggtactgacgcgctctgataaaaaccgtggtaagtcggacaacgtgccctccgaagaggttgtgaaaaagatgaaaaattattggcgccagcttttaaacgcgaagctgatcacacaacgtaaattcgataatttgaccaaggctgaacggggtggcctgagcgagttagataaggcaggatttattaaacgccagttagtggagactcgtcaaatcaccaaacatgtcgcgcagattttggacagccggatgaacaccaagtacgatgaaaatgacaaactgatccgtgaggtgaaagtcattactctgaagtccaaattagttagtgatttccggaaggactttcaattctacaaagtccgtgaaattaataactatcatcacgcacatgacgcgtacctgaatgcagtggttgggaccgcccttatcaagaaatatcctaagctggagtcggagtttgtctatggcgactataaggtatacgatgttcgcaaaatgattgcgaaatctgagcaggagatcggtaaggcaaccgcaaaatatttcttttactcaaacattatgaatttctttaagacagaaatcactctggccaacggggagattcgcaaacgtccgttgatcgaaacaaacggcgagactggcgaaattgtttgggacaaagggcgtgatttcgcgacggtgcgcaaggtactgagcatgcctcaagtcaatattgttaagaaaaccgaagtgcagacgggcgggttttccaaggaaagcatcttacccaaacgtaattcagataaacttattgcacgcaaaaaggactgggatccgaaaaagtatggaggcttcgacagtccaaccgtagcctactctgttctcgttgtagcgaaagtagaaaagggtaaatccaagaaactgaaatctgtcaaggagttgcttggaatcaccattatggagcgtagctccttcgagaagaacccgattgactttctggaagccaaaggatataaagaggtcaagaaagatcttatcattaagctgcctaagtattcactcttcgagctggaaaatggtcgtaaacgcatgctcgcttctgccggcgagttgcagaagggcaatgaattagcacttccatcaaagtacgttaacttcctgtatttggccagccattacgagaaactgaaggggtctccagaggacaacgaacagaaacaattatttgtagagcagcacaagcattatcttgatgaaatcattgagcaaatttccgaattcagtaaacgcgtaatcctggccgatgcaaacctcgacaaggtgctgagcgcttacaataagcatcgcgacaaacctatccgtgagcaggctgaaaatatcattcacctgttcacattaacgaacctgggcgctccggccgcttttaaatatttcgacacgacaatcgaccgtaagcgctataccagtacgaaagaagtgttggatgcgacccttattcaccagtcaattacaggattatatgagacccgtatcgaccttagccaattaggtggggatgcgccagcgcctgctcctgcacccgctccagctcctgccccagctccagcgcccgctcctgcacctgcgatggttagcaaaggtgaagaactgtttaccggcgttgtgccgattctggtggaactggatggtgatgtgaatggccataaatttagcgttagcggcgaaggcgaaggtgatgcgacctatggtaaactgaccctgaaatttatttgcaccaccggtaaactgccggttccgtggccgaccctggtgaccaccctgacctatggcgttcagtgctttagccgctatccggatcatatgaaacagcatgatttctttaaaagcgcgatgccggaaggctatgtgcaggaacgtaccatttttttcaaagatgatggcaactataaaacccgtgcggaagttaaatttgaaggcgataccctggtgaaccgcattgaactgaaaggtattgattttaaagaagatggcaacattctgggtcataaactggaatataattacaacagccataatgtgtatattatggccgataaacagaaaaatggcatcaaagtgaactttaaaatccgtcacaacattgaagatggtagcgtgcagctggcggatcattatcagcagaataccccgattggtgatggcccggtgctgctgccggataatcattatctgagcacccagagcgcgctgagcaaagatccgaatgaaaaacgtgatcatatggtgctgctggaatttgttaccgccgcgggcattaccctgggtatggatgaactgtataaa

SEQ ID NO: 365 - DNA, 4896 bp, Artificial Sequence
  SYNTHETIC
atggacaaaaagtactctattggcctggatatcgggaccaacagcgtcgggtgggctgttatcaccgacgagtataaagtaccttcgaaaaagttcaaagtgctgggcaacaccgatcgccattcaatcaaaaagaacttgattggtgcgctgttgtttgactccggggaaaccgccgaggcgactcgccttaaacgtacagcacgtcgccggtacactcggcgtaagaatcgcatttgctatttgcaggaaatctttagcaacgagatggcaaaagtcgatgactcgtttttccaccgcctcgaggaaagctttctggtggaggaagacaaaaagcatgagcgtcacccgatcttcggcaacattgtcgatgaagtagcgtatcatgaaaaatacccaaccatttaccacttacgcaaaaagctggtggacagcactgacaaagctgatttgcgccttatctatttagccctggcacatatgattaagtttcgtggtcacttcctgatcgaaggagacttaaatcccgacaacagtgatgttgataaattgtttattcagcttgtccaaacttacaatcaactgttcgaggaaaacccgatcaatgcctccggtgtggatgcaaaagccattttaagtgcacgccttagcaagtcccgtcgcttagaaaaccttatcgcgcagctgcccggcgagaaaaagaatggtttgtttgggaaccttattgccttgagcttaggcctcaccccgaatttcaaaagtaatttcgatcttgcagaagacgccaaattacaactgtcgaaggatacttatgatgacgatctcgataatctgttagcgcagattggtgaccaatacgccgatctttttctggcggctaaaaatctgagcgacgccatcttgctttcggatattctccgcgttaacaccgaaatcacgaaagcgcctcttagtgccagcatgattaaacgttatgatgaacaccaccaggacctgaccttactcaaagcgttggttcgccagcaactgccagagaagtacaaagaaatcttctttgatcagtcaaagaatggttatgccggctatattgacgggggtgcaagccaagaggaattctacaaatttatcaagcctattctggagaaaatggatggcaccgaagagttattggtgaagcttaaccgtgaagacctcctgcggaaacagcgcacattcgataatggttcgatcccacaccaaatccatttgggggagttacacgctattttgcgtcgccaggaagacttttaccctttcctgaaggataaccgggagaaaattgagaagatccttacctttcgtattccgtattacgtaggccccttagcacggggtaatagccgtttcgcgtggatgacacggaagtcggaagagacgatcaccccgtggaacttcgaagaggtagtcgacaagggcgcatcagcgcagtcttttattgaacgtatgacgaatttcgataaaaacttgcccaatgagaaggtgcttccgaaacattccttgttatatgaatattttacagtttacaacgagctgaccaaggttaaatacgtgacggaaggaatgcgcaagcccgcttttcttagcggtgagcaaaaaaaggcgatcgtcgacctgttattcaaaacgaatcgtaaggtgactgtaaagcaactcaaagaagattacttcaaaaagattgagtgcttcgacagcgtcgaaatctctggggtagaggatcggtttaacgcaagtttaggtacctaccatgacctgcttaaaatcattaaggataaagacttcttagataatgaagagaacgaagatattctcgaggacatcgtcttgacgttaaccttatttgaggatcgtgaaatgattgaggaacgcctcaaaacttatgcccacctgttcgacgataaggtgatgaagcagctgaaacgtcggcgctacacaggatggggccgcttgagtcgcaaacttattaacggaatccgtgacaagcaatccggcaaaacgattctggatttcttgaagtcggacggatttgctaatcgcaacttcatgcagttgatccatgatgactccctgacttttaaagaggatattcaaaaggcgcaggttagtggtcaaggcgacagcttacacgaacacatcgcaaatttggctggttcgccggccattaaaaaggggatcctccagaccgtgaaagttgtagatgagcttgttaaggtcatgggtcgtcataagcccgaaaacatcgtgattgaaatggcgcgggagaatcaaacgacccagaaaggacaaaagaatagccgtgaacggatgaagcggatcgaggaaggcattaaagagctggggtctcaaatcttgaaggaacaccctgtggagaacactcagctccaaaatgaaaaactttacctgtactatttgcagaacggacgcgatatgtacgtggaccaagagttggatattaatcggctgagtgactacgacgttgatcatatcgtcccgcagagcttcctcaaagacgattctattgacaataaggtactgacgcgctctgataaaaaccgtggtaagtcggacaacgtgccctccgaagaggttgtgaaaaagatgaaaaattattggcgccagcttttaaacgcgaagctgatcacacaacgtaaattcgataatttgaccaaggctgaacggggtggcctgagcgagttagataaggcaggatttattaaacgccagttagtggagactcgtcaaatcaccaaacatgtcgcgcagattttggacagccggatgaacaccaagtacgatgaaaatgacaaactgatccgtgaggtgaaagtcattactctgaagtccaaattagttagtgatttccggaaggactttcaattctacaaagtccgtgaaattaataactatcatcacgcacatgacgcgtacctgaatgcagtggttgggaccgcccttatcaagaaatatcctaagctggagtcggagtttgtctatggcgactataaggtatacgatgttcgcaaaatgattgcgaaatctgagcaggagatcggtaaggcaaccgcaaaatatttcttttactcaaacattatgaatttctttaagacagaaatcactctggccaacggggagattcgcaaacgtccgttgatcgaaacaaacggcgagactggcgaaattgtttgggacaaagggcgtgatttcgcgacggtgcgcaaggtactgagcatgcctcaagtcaatattgttaagaaaaccgaagtgcagacgggcgggttttccaaggaaagcatcttacccaaacgtaattcagataaacttattgcacgcaaaaaggactgggatccgaaaaagtatggaggcttcgacagtccaaccgtagcctactctgttctcgttgtagcgaaagtagaaaagggtaaatccaagaaactgaaatctgtcaaggagttgcttggaatcaccattatggagcgtagctccttcgagaagaacccgattgactttctggaagccaaaggatataaagaggtcaagaaagatcttatcattaagctgcctaagtattcactcttcgagctggaaaatggtcgtaaacgcatgctcgcttctgccggcgagttgcagaagggcaatgaattagcacttccatcaaagtacgttaacttcctgtatttggccagccattacgagaaactgaaggggtctccagaggacaacgaacagaaacaattatttgtagagcagcacaagcattatcttgatgaaatcattgagcaaatttccgaattcagtaaacgcgtaatcctggccgatgcaaacctcgacaaggtgctgagcgcttacaataagcatcgcgacaaacctatccgtgagcaggctgaaaatatcattcacctgttcacattaacgaacctgggcgctccggccgcttttaaatatttcgacacgacaatcgaccgtaagcgctataccagtacgaaagaagtgttggatgcgacccttattcaccagtcaattacaggattatatgagacccgtatcgaccttagccaattaggtggggatgcgccagcgcctgctcctgcacccgctccagctcctgccccagctccagcgcccgctcctgctcctgcacctgcgatggttagcaaaggtgaagaactgtttaccggcgttgtgccgattctggtggaactggatggtgatgtgaatggccataaatttagcgttagcggcgaaggcgaaggtgatgcgacctatggtaaactgaccctgaaatttatttgcaccaccggtaaactgccggttccgtggccgaccctggtgaccaccctgacctatggcgttcagtgctttagccgctatccggatcatatgaaacagcatgatttctttaaaagcgcgatgccggaaggctatgtgcaggaacgtaccatttttttcaaagatgatggcaactataaaacccgtgcggaagttaaatttgaaggcgataccctggtgaaccgcattgaactgaaaggtattgattttaaagaagatggcaacattctgggtcataaactggaatataattacaacagccataatgtgtatattatggccgataaacagaaaaatggcatcaaagtgaactttaaaatccgtcacaacattgaagatggtagcgtgcagctggcggatcattatcagcagaataccccgattggtgatggcccggtgctgctgccggataatcattatctgagcacccagagcgcgctgagcaaagatccgaatgaaaaacgtgatcatatggtgctgctggaatttgttaccgccgcgggcattaccctgggtatggatgaactgtataaa

SEQ ID NO: 366 - DNA, 4902 bp, Artificial Sequence
  SYNTHETIC
atggacaaaaagtactctattggcctggatatcgggaccaacagcgtcgggtgggctgttatcaccgacgagtataaagtaccttcgaaaaagttcaaagtgctgggcaacaccgatcgccattcaatcaaaaagaacttgattggtgcgctgttgtttgactccggggaaaccgccgaggcgactcgccttaaacgtacagcacgtcgccggtacactcggcgtaagaatcgcatttgctatttgcaggaaatctttagcaacgagatggcaaaagtcgatgactcgtttttccaccgcctcgaggaaagctttctggtggaggaagacaaaaagcatgagcgtcacccgatcttcggcaacattgtcgatgaagtagcgtatcatgaaaaatacccaaccatttaccacttacgcaaaaagctggtggacagcactgacaaagctgatttgcgccttatctatttagccctggcacatatgattaagtttcgtggtcacttcctgatcgaaggagacttaaatcccgacaacagtgatgttgataaattgtttattcagcttgtccaaacttacaatcaactgttcgaggaaaacccgatcaatgcctccggtgtggatgcaaaagccattttaagtgcacgccttagcaagtcccgtcgcttagaaaaccttatcgcgcagctgcccggcgagaaaaagaatggtttgtttgggaaccttattgccttgagcttaggcctcaccccgaatttcaaaagtaatttcgatcttgcagaagacgccaaattacaactgtcgaaggatacttatgatgacgatctcgataatctgttagcgcagattggtgaccaatacgccgatctttttctggcggctaaaaatctgagcgacgccatcttgctttcggatattctccgcgttaacaccgaaatcacgaaagcgcctcttagtgccagcatgattaaacgttatgatgaacaccaccaggacctgaccttactcaaagcgttggttcgccagcaactgccagagaagtacaaagaaatcttctttgatcagtcaaagaatggttatgccggctatattgacgggggtgcaagccaagaggaattctacaaatttatcaagcctattctggagaaaatggatggcaccgaagagttattggtgaagcttaaccgtgaagacctcctgcggaaacagcgcacattcgataatggttcgatcccacaccaaatccatttgggggagttacacgctattttgcgtcgccaggaagacttttaccctttcctgaaggataaccgggagaaaattgagaagatccttacctttcgtattccgtattacgtaggccccttagcacggggtaatagccgtttcgcgtggatgacacggaagtcggaagagacgatcaccccgtggaacttcgaagaggtagtcgacaagggcgcatcagcgcagtcttttattgaacgtatgacgaatttcgataaaaacttgcccaatgagaaggtgcttccgaaacattccttgttatatgaatattttacagtttacaacgagctgaccaaggttaaatacgtgacggaaggaatgcgcaagcccgcttttcttagcggtgagcaaaaaaaggcgatcgtcgacctgttattcaaaacgaatcgtaaggtgactgtaaagcaactcaaagaagattacttcaaaaagattgagtgcttcgacagcgtcgaaatctctggggtagaggatcggtttaacgcaagtttaggtacctaccatgacctgcttaaaatcattaaggataaagacttcttagataatgaagagaacgaagatattctcgaggacatcgtcttgacgttaaccttatttgaggatcgtgaaatgattgaggaacgcctcaaaacttatgcccacctgttcgacgataaggtgatgaagcagctgaaacgtcggcgctacacaggatggggccgcttgagtcgcaaacttattaacggaatccgtgacaagcaatccggcaaaacgattctggatttcttgaagtcggacggatttgctaatcgcaacttcatgcagttgatccatgatgactccctgacttttaaagaggatattcaaaaggcgcaggttagtggtcaaggcgacagcttacacgaacacatcgcaaatttggctggttcgccggccattaaaaaggggatcctccagaccgtgaaagttgtagatgagcttgttaaggtcatgggtcgtcataagcccgaaaacatcgtgattgaaatggcgcgggagaatcaaacgacccagaaaggacaaaagaatagccgtgaacggatgaagcggatcgaggaaggcattaaagagctggggtctcaaatcttgaaggaacaccctgtggagaacactcagctccaaaatgaaaaactttacctgtactatttgcagaacggacgcgatatgtacgtggaccaagagttggatattaatcggctgagtgactacgacgttgatcatatcgtcccgcagagcttcctcaaagacgattctattgacaataaggtactgacgcgctctgataaaaaccgtggtaagtcggacaacgtgccctccgaagaggttgtgaaaaagatgaaaaattattggcgccagcttttaaacgcgaagctgatcacacaacgtaaattcgataatttgaccaaggctgaacggggtggcctgagcgagttagataaggcaggatttattaaacgccagttagtggagactcgtcaaatcaccaaacatgtcgcgcagattttggacagccggatgaacaccaagtacgatgaaaatgacaaactgatccgtgaggtgaaagtcattactctgaagtccaaattagttagtgatttccggaaggactttcaattctacaaagtccgtgaaattaataactatcatcacgcacatgacgcgtacctgaatgcagtggttgggaccgcccttatcaagaaatatcctaagctggagtcggagtttgtctatggcgactataaggtatacgatgttcgcaaaatgattgcgaaatctgagcaggagatcggtaaggcaaccgcaaaatatttcttttactcaaacattatgaatttctttaagacagaaatcactctggccaacggggagattcgcaaacgtccgttgatcgaaacaaacggcgagactggcgaaattgtttgggacaaagggcgtgatttcgcgacggtgcgcaaggtactgagcatgcctcaagtcaatattgttaagaaaaccgaagtgcagacgggcgggttttccaaggaaagcatcttacccaaacgtaattcagataaacttattgcacgcaaaaaggactgggatccgaaaaagtatggaggcttcgacagtccaaccgtagcctactctgttctcgttgtagcgaaagtagaaaagggtaaatccaagaaactgaaatctgtcaaggagttgcttggaatcaccattatggagcgtagctccttcgagaagaacccgattgactttctggaagccaaaggatataaagaggtcaagaaagatcttatcattaagctgcctaagtattcactcttcgagctggaaaatggtcgtaaacgcatgctcgcttctgccggcgagttgcagaagggcaatgaattagcacttccatcaaagtacgttaacttcctgtatttggccagccattacgagaaactgaaggggtctccagaggacaacgaacagaaacaattatttgtagagcagcacaagcattatcttgatgaaatcattgagcaaatttccgaattcagtaaacgcgtaatcctggccgatgcaaacctcgacaaggtgctgagcgcttacaataagcatcgcgacaaacctatccgtgagcaggctgaaaatatcattcacctgttcacattaacgaacctgggcgctccggccgcttttaaatatttcgacacgacaatcgaccgtaagcgctataccagtacgaaagaagtgttggatgcgacccttattcaccagtcaattacaggattatatgagacccgtatcgaccttagccaattaggtggggatgcgccagcgcctgctcctgcacccgctccagctcctgccccagctccagcgcccgctcctgcgccagctcctgcacctgcgatggttagcaaaggtgaagaactgtttaccggcgttgtgccgattctggtggaactggatggtgatgtgaatggccataaatttagcgttagcggcgaaggcgaaggtgatgcgacctatggtaaactgaccctgaaatttatttgcaccaccggtaaactgccggttccgtggccgaccctggtgaccaccctgacctatggcgttcagtgctttagccgctatccggatcatatgaaacagcatgatttctttaaaagcgcgatgccggaaggctatgtgcaggaacgtaccatttttttcaaagatgatggcaactataaaacccgtgcggaagttaaatttgaaggcgataccctggtgaaccgcattgaactgaaaggtattgattttaaagaagatggcaacattctgggtcataaactggaatataattacaacagccataatgtgtatattatggccgataaacagaaaaatggcatcaaagtgaactttaaaatccgtcacaacattgaagatggtagcgtgcagctggcggatcattatcagcagaataccccgattggtgatggcccggtgctgctgccggataatcattatctgagcacccagagcgcgctgagcaaagatccgaatgaaaaacgtgatcatatggtgctgctggaatttgttaccgccgcgggcattaccctgggtatggatgaactgtataaa

SEQ ID NO: 367 - DNA, 4908 bp, Artificial Sequence
  SYNTHETIC
atggacaaaaagtactctattggcctggatatcgggaccaacagcgtcgggtgggctgttatcaccgacgagtataaagtaccttcgaaaaagttcaaagtgctgggcaacaccgatcgccattcaatcaaaaagaacttgattggtgcgctgttgtttgactccggggaaaccgccgaggcgactcgccttaaacgtacagcacgtcgccggtacactcggcgtaagaatcgcatttgctatttgcaggaaatctttagcaacgagatggcaaaagtcgatgactcgtttttccaccgcctcgaggaaagctttctggtggaggaagacaaaaagcatgagcgtcacccgatcttcggcaacattgtcgatgaagtagcgtatcatgaaaaatacccaaccatttaccacttacgcaaaaagctggtggacagcactgacaaagctgatttgcgccttatctatttagccctggcacatatgattaagtttcgtggtcacttcctgatcgaaggagacttaaatcccgacaacagtgatgttgataaattgtttattcagcttgtccaaacttacaatcaactgttcgaggaaaacccgatcaatgcctccggtgtggatgcaaaagccattttaagtgcacgccttagcaagtcccgtcgcttagaaaaccttatcgcgcagctgcccggcgagaaaaagaatggtttgtttgggaaccttattgccttgagcttaggcctcaccccgaatttcaaaagtaatttcgatcttgcagaagacgccaaattacaactgtcgaaggatacttatgatgacgatctcgataatctgttagcgcagattggtgaccaatacgccgatctttttctggcggctaaaaatctgagcgacgccatcttgctttcggatattctccgcgttaacaccgaaatcacgaaagcgcctcttagtgccagcatgattaaacgttatgatgaacaccaccaggacctgaccttactcaaagcgttggttcgccagcaactgccagagaagtacaaagaaatcttctttgatcagtcaaagaatggttatgccggctatattgacgggggtgcaagccaagaggaattctacaaatttatcaagcctattctggagaaaatggatggcaccgaagagttattggtgaagcttaaccgtgaagacctcctgcggaaacagcgcacattcgataatggttcgatcccacaccaaatccatttgggggagttacacgctattttgcgtcgccaggaagacttttaccctttcctgaaggataaccgggagaaaattgagaagatccttacctttcgtattccgtattacgtaggccccttagcacggggtaatagccgtttcgcgtggatgacacggaagtcggaagagacgatcaccccgtggaacttcgaagaggtagtcgacaagggcgcatcagcgcagtcttttattgaacgtatgacgaatttcgataaaaacttgcccaatgagaaggtgcttccgaaacattccttgttatatgaatattttacagtttacaacgagctgaccaaggttaaatacgtgacggaaggaatgcgcaagcccgcttttcttagcggtgagcaaaaaaaggcgatcgtcgacctgttattcaaaacgaatcgtaaggtgactgtaaagcaactcaaagaagattacttcaaaaagattgagtgcttcgacagcgtcgaaatctctggggtagaggatcggtttaacgcaagtttaggtacctaccatgacctgcttaaaatcattaaggataaagacttcttagataatgaagagaacgaagatattctcgaggacatcgtcttgacgttaaccttatttgaggatcgtgaaatgattgaggaacgcctcaaaacttatgcccacctgttcgacgataaggtgatgaagcagctgaaacgtcggcgctacacaggatggggccgcttgagtcgcaaacttattaacggaatccgtgacaagcaatccggcaaaacgattctggatttcttgaagtcggacggatttgctaatcgcaacttcatgcagttgatccatgatgactccctgacttttaaagaggatattcaaaaggcgcaggttagtggtcaaggcgacagcttacacgaacacatcgcaaatttggctggttcgccggccattaaaaaggggatcctccagaccgtgaaagttgtagatgagcttgttaaggtcatgggtcgtcataagcccgaaaacatcgtgattgaaatggcgcgggagaatcaaacgacccagaaaggacaaaagaatagccgtgaacggatgaagcggatcgaggaaggcattaaagagctggggtctcaaatcttgaaggaacaccctgtggagaacactcagctccaaaatgaaaaactttacctgtactatttgcagaacggacgcgatatgtacgtggaccaagagttggatattaatcggctgagtgactacgacgttgatcatatcgtcccgcagagcttcctcaaagacgattctattgacaataaggtactgacgcgctctgataaaaaccgtggtaagtcggacaacgtgccctccgaagaggttgtgaaaaagatgaaaaattattggcgccagcttttaaacgcgaagctgatcacacaacgtaaattcgataatttgaccaaggctgaacggggtggcctgagcgagttagataaggcaggatttattaaacgccagttagtggagactcgtcaaatcaccaaacatgtcgcgcagattttggacagccggatgaacaccaagtacgatgaaaatgacaaactgatccgtgaggtgaaagtcattactctgaagtccaaattagttagtgatttccggaaggactttcaattctacaaagtccgtgaaattaataactatcatcacgcacatgacgcgtacctgaatgcagtggttgggaccgcccttatcaagaaatatcctaagctggagtcggagtttgtctatggcgactataaggtatacgatgttcgcaaaatgattgcgaaatctgagcaggagatcggtaaggcaaccgcaaaatatttcttttactcaaacattatgaatttctttaagacagaaatcactctggccaacggggagattcgcaaacgtccgttgatcgaaacaaacggcgagactggcgaaattgtttgggacaaagggcgtgatttcgcgacggtgcgcaaggtactgagcatgcctcaagtcaatattgttaagaaaaccgaagtgcagacgggcgggttttccaaggaaagcatcttacccaaacgtaattcagataaacttattgcacgcaaaaaggactgggatccgaaaaagtatggaggcttcgacagtccaaccgtagcctactctgttctcgttgtagcgaaagtagaaaagggtaaatccaagaaactgaaatctgtcaaggagttgcttggaatcaccattatggagcgtagctccttcgagaagaacccgattgactttctggaagccaaaggatataaagaggtcaagaaagatcttatcattaagctgcctaagtattcactcttcgagctggaaaatggtcgtaaacgcatgctcgcttctgccggcgagttgcagaagggcaatgaattagcacttccatcaaagtacgttaacttcctgtatttggccagccattacgagaaactgaaggggtctccagaggacaacgaacagaaacaattatttgtagagcagcacaagcattatcttgatgaaatcattgagcaaatttccgaattcagtaaacgcgtaatcctggccgatgcaaacctcgacaaggtgctgagcgcttacaataagcatcgcgacaaacctatccgtgagcaggctgaaaatatcattcacctgttcacattaacgaacctgggcgctccggccgcttttaaatatttcgacacgacaatcgaccgtaagcgctataccagtacgaaagaagtgttggatgcgacccttattcaccagtcaattacaggattatatgagacccgtatcgaccttagccaattaggtggggatgcgccagcgcctgctcctgcacccgctccagctcctgccccagctccagcgcccgctcctgcgccagctcctgcacctgctccagcgatggttagcaaaggtgaagaactgtttaccggcgttgtgccgattctggtggaactggatggtgatgtgaatggccataaatttagcgttagcggcgaaggcgaaggtgatgcgacctatggtaaactgaccctgaaatttatttgcaccaccggtaaactgccggttccgtggccgaccctggtgaccaccctgacctatggcgttcagtgctttagccgctatccggatcatatgaaacagcatgatttctttaaaagcgcgatgccggaaggctatgtgcaggaacgtaccatttttttcaaagatgatggcaactataaaacccgtgcggaagttaaatttgaaggcgataccctggtgaaccgcattgaactgaaaggtattgattttaaagaagatggcaacattctgggtcataaactggaatataattacaacagccataatgtgtatattatggccgataaacagaaaaatggcatcaaagtgaactttaaaatccgtcacaacattgaagatggtagcgtgcagctggcggatcattatcagcagaataccccgattggtgatggcccggtgctgctgccggataatcattatctgagcacccagagcgcgctgagcaaagatccgaatgaaaaacgtgatcatatggtgctgctggaatttgttaccgccgcgggcattaccctgggtatggatgaactgtataaa

SEQ ID NO: 368 - DNA, 4848 bp, Artificial Sequence
  SYNTHETIC
atggacaaaaagtactctattggcctggatatcgggaccaacagcgtcgggtgggctgttatcaccgacgagtataaagtaccttcgaaaaagttcaaagtgctgggcaacaccgatcgccattcaatcaaaaagaacttgattggtgcgctgttgtttgactccggggaaaccgccgaggcgactcgccttaaacgtacagcacgtcgccggtacactcggcgtaagaatcgcatttgctatttgcaggaaatctttagcaacgagatggcaaaagtcgatgactcgtttttccaccgcctcgaggaaagctttctggtggaggaagacaaaaagcatgagcgtcacccgatcttcggcaacattgtcgatgaagtagcgtatcatgaaaaatacccaaccatttaccacttacgcaaaaagctggtggacagcactgacaaagctgatttgcgccttatctatttagccctggcacatatgattaagtttcgtggtcacttcctgatcgaaggagacttaaatcccgacaacagtgatgttgataaattgtttattcagcttgtccaaacttacaatcaactgttcgaggaaaacccgatcaatgcctccggtgtggatgcaaaagccattttaagtgcacgccttagcaagtcccgtcgcttagaaaaccttatcgcgcagctgcccggcgagaaaaagaatggtttgtttgggaaccttattgccttgagcttaggcctcaccccgaatttcaaaagtaatttcgatcttgcagaagacgccaaattacaactgtcgaaggatacttatgatgacgatctcgataatctgttagcgcagattggtgaccaatacgccgatctttttctggcggctaaaaatctgagcgacgccatcttgctttcggatattctccgcgttaacaccgaaatcacgaaagcgcctcttagtgccagcatgattaaacgttatgatgaacaccaccaggacctgaccttactcaaagcgttggttcgccagcaactgccagagaagtacaaagaaatcttctttgatcagtcaaagaatggttatgccggctatattgacgggggtgcaagccaagaggaattctacaaatttatcaagcctattctggagaaaatggatggcaccgaagagttattggtgaagcttaaccgtgaagacctcctgcggaaacagcgcacattcgataatggttcgatcccacaccaaatccatttgggggagttacacgctattttgcgtcgccaggaagacttttaccctttcctgaaggataaccgggagaaaattgagaagatccttacctttcgtattccgtattacgtaggccccttagcacggggtaatagccgtttcgcgtggatgacacggaagtcggaagagacgatcaccccgtggaacttcgaagaggtagtcgacaagggcgcatcagcgcagtcttttattgaacgtatgacgaatttcgataaaaacttgcccaatgagaaggtgcttccgaaacattccttgttatatgaatattttacagtttacaacgagctgaccaaggttaaatacgtgacggaaggaatgcgcaagcccgcttttcttagcggtgagcaaaaaaaggcgatcgtcgacctgttattcaaaacgaatcgtaaggtgactgtaaagcaactcaaagaagattacttcaaaaagattgagtgcttcgacagcgtcgaaatctctggggtagaggatcggtttaacgcaagtttaggtacctaccatgacctgcttaaaatcattaaggataaagacttcttagataatgaagagaacgaagatattctcgaggacatcgtcttgacgttaaccttatttgaggatcgtgaaatgattgaggaacgcctcaaaacttatgcccacctgttcgacgataaggtgatgaagcagctgaaacgtcggcgctacacaggatggggccgcttgagtcgcaaacttattaacggaatccgtgacaagcaatccggcaaaacgattctggatttcttgaagtcggacggatttgctaatcgcaacttcatgcagttgatccatgatgactccctgacttttaaagaggatattcaaaaggcgcaggttagtggtcaaggcgacagcttacacgaacacatcgcaaatttggctggttcgccggccattaaaaaggggatcctccagaccgtgaaagttgtagatgagcttgttaaggtcatgggtcgtcataagcccgaaaacatcgtgattgaaatggcgcgggagaatcaaacgacccagaaaggacaaaagaatagccgtgaacggatgaagcggatcgaggaaggcattaaagagctggggtctcaaatcttgaaggaacaccctgtggagaacactcagctccaaaatgaaaaactttacctgtactatttgcagaacggacgcgatatgtacgtggaccaagagttggatattaatcggctgagtgactacgacgttgatcatatcgtcccgcagagcttcctcaaagacgattctattgacaataaggtactgacgcgctctgataaaaaccgtggtaagtcggacaacgtgccctccgaagaggttgtgaaaaagatgaaaaattattggcgccagcttttaaacgcgaagctgatcacacaacgtaaattcgataatttgaccaaggctgaacggggtggcctgagcgagttagataaggcaggatttattaaacgccagttagtggagactcgtcaaatcaccaaacatgtcgcgcagattttggacagccggatgaacaccaagtacgatgaaaatgacaaactgatccgtgaggtgaaagtcattactctgaagtccaaattagttagtgatttccggaaggactttcaattctacaaagtccgtgaaattaataactatcatcacgcacatgacgcgtacctgaatgcagtggttgggaccgcccttatcaagaaatatcctaagctggagtcggagtttgtctatggcgactataaggtatacgatgttcgcaaaatgattgcgaaatctgagcaggagatcggtaaggcaaccgcaaaatatttcttttactcaaacattatgaatttctttaagacagaaatcactctggccaacggggagattcgcaaacgtccgttgatcgaaacaaacggcgagactggcgaaattgtttgggacaaagggcgtgatttcgcgacggtgcgcaaggtactgagcatgcctcaagtcaatattgttaagaaaaccgaagtgcagacgggcgggttttccaaggaaagcatcttacccaaacgtaattcagataaacttattgcacgcaaaaaggactgggatccgaaaaagtatggaggcttcgacagtccaaccgtagcctactctgttctcgttgtagcgaaagtagaaaagggtaaatccaagaaactgaaatctgtcaaggagttgcttggaatcaccattatggagcgtagctccttcgagaagaacccgattgactttctggaagccaaaggatataaagaggtcaagaaagatcttatcattaagctgcctaagtattcactcttcgagctggaaaatggtcgtaaacgcatgctcgcttctgccggcgagttgcagaagggcaatgaattagcacttccatcaaagtacgttaacttcctgtatttggccagccattacgagaaactgaaggggtctccagaggacaacgaacagaaacaattatttgtagagcagcacaagcattatcttgatgaaatcattgagcaaatttccgaattcagtaaacgcgtaatcctggccgatgcaaacctcgacaaggtgctgagcgcttacaataagcatcgcgacaaacctatccgtgagcaggctgaaaatatcattcacctgttcacattaacgaacctgggcgctccggccgcttttaaatatttcgacacgacaatcgaccgtaagcgctataccagtacgaaagaagtgttggatgcgacccttattcaccagtcaattacaggattatatgagacccgtatcgaccttagccaattaggtggggatggtagcgcaggtagtgcagcaggtagcggtgaatttatggtgagcaaaggtgaagaggataatatggccatcatcaaagaattcatgcgcttcaaagttcatatggaaggtagcgttaatggccacgaatttgaaattgaaggtgaaggcgaaggtcgtccgtatgaaggcacccagaccgcaaaactgaaagttaccaaaggtggtccgctgccgtttgcatgggatattctgagtccgcagtttatgtatggtagcaaagcctatgttaaacatccggcagatatcccggattatctgaaactgagctttccggaaggttttaaatgggaacgtgtgatgaattttgaagatggtggtgttgttaccgttacacaggatagcagcctgcaggatggtgaatttatctataaagttaaactgcgtggcacgaattttccgagtgatggtccggttatgcagaaaaaaaccatgggttgggaagcaagcagcgaacgtatgtatccggaagatggcgcactgaaaggtgaaattaaacagcgtctgaagctgaaagatggcggtcattatgatgcagaagttaaaaccacctacaaagccaaaaaaccggttcagctgcctggtgcatataacgttaacattaaactggatatcaccagccacaacgaggattataccattgttgaacagtatgaacgtgcagaaggtcgccatagtaccggtggtatggatgaactgtataaa

SEQ ID NO: 369 - DNA, 4872 bp, Artificial Sequence
  SYNTHETIC
atggacaaaaagtactctattggcctggatatcgggaccaacagcgtcgggtgggctgttatcaccgacgagtataaagtaccttcgaaaaagttcaaagtgctgggcaacaccgatcgccattcaatcaaaaagaacttgattggtgcgctgttgtttgactccggggaaaccgccgaggcgactcgccttaaacgtacagcacgtcgccggtacactcggcgtaagaatcgcatttgctatttgcaggaaatctttagcaacgagatggcaaaagtcgatgactcgtttttccaccgcctcgaggaaagctttctggtggaggaagacaaaaagcatgagcgtcacccgatcttcggcaacattgtcgatgaagtagcgtatcatgaaaaatacccaaccatttaccacttacgcaaaaagctggtggacagcactgacaaagctgatttgcgccttatctatttagccctggcacatatgattaagtttcgtggtcacttcctgatcgaaggagacttaaatcccgacaacagtgatgttgataaattgtttattcagcttgtccaaacttacaatcaactgttcgaggaaaacccgatcaatgcctccggtgtggatgcaaaagccattttaagtgcacgccttagcaagtcccgtcgcttagaaaaccttatcgcgcagctgcccggcgagaaaaagaatggtttgtttgggaaccttattgccttgagcttaggcctcaccccgaatttcaaaagtaatttcgatcttgcagaagacgccaaattacaactgtcgaaggatacttatgatgacgatctcgataatctgttagcgcagattggtgaccaatacgccgatctttttctggcggctaaaaatctgagcgacgccatcttgctttcggatattctccgcgttaacaccgaaatcacgaaagcgcctcttagtgccagcatgattaaacgttatgatgaacaccaccaggacctgaccttactcaaagcgttggttcgccagcaactgccagagaagtacaaagaaatcttctttgatcagtcaaagaatggttatgccggctatattgacgggggtgcaagccaagaggaattctacaaatttatcaagcctattctggagaaaatggatggcaccgaagagttattggtgaagcttaaccgtgaagacctcctgcggaaacagcgcacattcgataatggttcgatcccacaccaaatccatttgggggagttacacgctattttgcgtcgccaggaagacttttaccctttcctgaaggataaccgggagaaaattgagaagatccttacctttcgtattccgtattacgtaggccccttagcacggggtaatagccgtttcgcgtggatgacacggaagtcggaagagacgatcaccccgtggaacttcgaagaggtagtcgacaagggcgcatcagcgcagtcttttattgaacgtatgacgaatttcgataaaaacttgcccaatgagaaggtgcttccgaaacattccttgttatatgaatattttacagtttacaacgagctgaccaaggttaaatacgtgacggaaggaatgcgcaagcccgcttttcttagcggtgagcaaaaaaaggcgatcgtcgacctgttattcaaaacgaatcgtaaggtgactgtaaagcaactcaaagaagattacttcaaaaagattgagtgcttcgacagcgtcgaaatctctggggtagaggatcggtttaacgcaagtttaggtacctaccatgacctgcttaaaatcattaaggataaagacttcttagataatgaagagaacgaagatattctcgaggacatcgtcttgacgttaaccttatttgaggatcgtgaaatgattgaggaacgcctcaaaacttatgcccacctgttcgacgataaggtgatgaagcagctgaaacgtcggcgctacacaggatggggccgcttgagtcgcaaacttattaacggaatccgtgacaagcaatccggcaaaacgattctggatttcttgaagtcggacggatttgctaatcgcaacttcatgcagttgatccatgatgactccctgacttttaaagaggatattcaaaaggcgcaggttagtggtcaaggcgacagcttacacgaacacatcgcaaatttggctggttcgccggccattaaaaaggggatcctccagaccgtgaaagttgtagatgagcttgttaaggtcatgggtcgtcataagcccgaaaacatcgtgattgaaatggcgcgggagaatcaaacgacccagaaaggacaaaagaatagccgtgaacggatgaagcggatcgaggaaggcattaaagagctggggtctcaaatcttgaaggaacaccctgtggagaacactcagctccaaaatgaaaaactttacctgtactatttgcagaacggacgcgatatgtacgtggaccaagagttggatattaatcggctgagtgactacgacgttgatcatatcgtcccgcagagcttcctcaaagacgattctattgacaataaggtactgacgcgctctgataaaaaccgtggtaagtcggacaacgtgccctccgaagaggttgtgaaaaagatgaaaaattattggcgccagcttttaaacgcgaagctgatcacacaacgtaaattcgataatttgaccaaggctgaacggggtggcctgagcgagttagataaggcaggatttattaaacgccagttagtggagactcgtcaaatcaccaaacatgtcgcgcagattttggacagccggatgaacaccaagtacgatgaaaatgacaaactgatccgtgaggtgaaagtcattactctgaagtccaaattagttagtgatttccggaaggactttcaattctacaaagtccgtgaaattaataactatcatcacgcacatgacgcgtacctgaatgcagtggttgggaccgcccttatcaagaaatatcctaagctggagtcggagtttgtctatggcgactataaggtatacgatgttcgcaaaatgattgcgaaatctgagcaggagatcggtaaggcaaccgcaaaatatttcttttactcaaacattatgaatttctttaagacagaaatcactctggccaacggggagattcgcaaacgtccgttgatcgaaacaaacggcgagactggcgaaattgtttgggacaaagggcgtgatttcgcgacggtgcgcaaggtactgagcatgcctcaagtcaatattgttaagaaaaccgaagtgcagacgggcgggttttccaaggaaagcatcttacccaaacgtaattcagataaacttattgcacgcaaaaaggactgggatccgaaaaagtatggaggcttcgacagtccaaccgtagcctactctgttctcgttgtagcgaaagtagaaaagggtaaatccaagaaactgaaatctgtcaaggagttgcttggaatcaccattatggagcgtagctccttcgagaagaacccgattgactttctggaagccaaaggatataaagaggtcaagaaagatcttatcattaagctgcctaagtattcactcttcgagctggaaaatggtcgtaaacgcatgctcgcttctgccggcgagttgcagaagggcaatgaattagcacttccatcaaagtacgttaacttcctgtatttggccagccattacgagaaactgaaggggtctccagaggacaacgaacagaaacaattatttgtagagcagcacaagcattatcttgatgaaatcattgagcaaatttccgaattcagtaaacgcgtaatcctggccgatgcaaacctcgacaaggtgctgagcgcttacaataagcatcgcgacaaacctatccgtgagcaggctgaaaatatcattcacctgttcacattaacgaacctgggcgctccggccgcttttaaatatttcgacacgacaatcgaccgtaagcgctataccagtacgaaagaagtgttggatgcgacccttattcaccagtcaattacaggattatatgagacccgtatcgaccttagccaattaggtggggatggaggcggaggatcaggcggtggcggaagtggtggaggtgggtcgggaggtggtggtagcatggtgagcaaaggtgaagaggataatatggccatcatcaaagaattcatgcgcttcaaagttcatatggaaggtagcgttaatggccacgaatttgaaattgaaggtgaaggcgaaggtcgtccgtatgaaggcacccagaccgcaaaactgaaagttaccaaaggtggtccgctgccgtttgcatgggatattctgagtccgcagtttatgtatggtagcaaagcctatgttaaacatccggcagatatcccggattatctgaaactgagctttccggaaggttttaaatgggaacgtgtgatgaattttgaagatggtggtgttgttaccgttacacaggatagcagcctgcaggatggtgaatttatctataaagttaaactgcgtggcacgaattttccgagtgatggtccggttatgcagaaaaaaaccatgggttgggaagcaagcagcgaacgtatgtatccggaagatggcgcactgaaaggtgaaattaaacagcgtctgaagctgaaagatggcggtcattatgatgcagaagttaaaaccacctacaaagccaaaaaaccggttcagctgcctggtgcatataacgttaacattaaactggatatcaccagccacaacgaggattataccattgttgaacagtatgaacgtgcagaaggtcgccatagtaccggtggtatggatgaactgtataaa

SEQ ID NO: 370 - DNA, 4857 bp, Artificial Sequence
  SYNTHETIC
atggacaaaaagtactctattggcctggatatcgggaccaacagcgtcgggtgggctgttatcaccgacgagtataaagtaccttcgaaaaagttcaaagtgctgggcaacaccgatcgccattcaatcaaaaagaacttgattggtgcgctgttgtttgactccggggaaaccgccgaggcgactcgccttaaacgtacagcacgtcgccggtacactcggcgtaagaatcgcatttgctatttgcaggaaatctttagcaacgagatggcaaaagtcgatgactcgtttttccaccgcctcgaggaaagctttctggtggaggaagacaaaaagcatgagcgtcacccgatcttcggcaacattgtcgatgaagtagcgtatcatgaaaaatacccaaccatttaccacttacgcaaaaagctggtggacagcactgacaaagctgatttgcgccttatctatttagccctggcacatatgattaagtttcgtggtcacttcctgatcgaaggagacttaaatcccgacaacagtgatgttgataaattgtttattcagcttgtccaaacttacaatcaactgttcgaggaaaacccgatcaatgcctccggtgtggatgcaaaagccattttaagtgcacgccttagcaagtcccgtcgcttagaaaaccttatcgcgcagctgcccggcgagaaaaagaatggtttgtttgggaaccttattgccttgagcttaggcctcaccccgaatttcaaaagtaatttcgatcttgcagaagacgccaaattacaactgtcgaaggatacttatgatgacgatctcgataatctgttagcgcagattggtgaccaatacgccgatctttttctggcggctaaaaatctgagcgacgccatcttgctttcggatattctccgcgttaacaccgaaatcacgaaagcgcctcttagtgccagcatgattaaacgttatgatgaacaccaccaggacctgaccttactcaaagcgttggttcgccagcaactgccagagaagtacaaagaaatcttctttgatcagtcaaagaatggttatgccggctatattgacgggggtgcaagccaagaggaattctacaaatttatcaagcctattctggagaaaatggatggcaccgaagagttattggtgaagcttaaccgtgaagacctcctgcggaaacagcgcacattcgataatggttcgatcccacaccaaatccatttgggggagttacacgctattttgcgtcgccaggaagacttttaccctttcctgaaggataaccgggagaaaattgagaagatccttacctttcgtattccgtattacgtaggccccttagcacggggtaatagccgtttcgcgtggatgacacggaagtcggaagagacgatcaccccgtggaacttcgaagaggtagtcgacaagggcgcatcagcgcagtcttttattgaacgtatgacgaatttcgataaaaacttgcccaatgagaaggtgcttccgaaacattccttgttatatgaatattttacagtttacaacgagctgaccaaggttaaatacgtgacggaaggaatgcgcaagcccgcttttcttagcggtgagcaaaaaaaggcgatcgtcgacctgttattcaaaacgaatcgtaaggtgactgtaaagcaactcaaagaagattacttcaaaaagattgagtgcttcgacagcgtcgaaatctctggggtagaggatcggtttaacgcaagtttaggtacctaccatgacctgcttaaaatcattaaggataaagacttcttagataatgaagagaacgaagatattctcgaggacatcgtcttgacgttaaccttatttgaggatcgtgaaatgattgaggaacgcctcaaaacttatgcccacctgttcgacgataaggtgatgaagcagctgaaacgtcggcgctacacaggatggggccgcttgagtcgcaaacttattaacggaatccgtgacaagcaatccggcaaaacgattctggatttcttgaagtcggacggatttgctaatcgcaacttcatgcagttgatccatgatgactccctgacttttaaagaggatattcaaaaggcgcaggttagtggtcaaggcgacagcttacacgaacacatcgcaaatttggctggttcgccggccattaaaaaggggatcctccagaccgtgaaagttgtagatgagcttgttaaggtcatgggtcgtcataagcccgaaaacatcgtgattgaaatggcgcgggagaatcaaacgacccagaaaggacaaaagaatagccgtgaacggatgaagcggatcgaggaaggcattaaagagctggggtctcaaatcttgaaggaacaccctgtggagaacactcagctccaaaatgaaaaactttacctgtactatttgcagaacggacgcgatatgtacgtggaccaagagttggatattaatcggctgagtgactacgacgttgatcatatcgtcccgcagagcttcctcaaagacgattctattgacaataaggtactgacgcgctctgataaaaaccgtggtaagtcggacaacgtgccctccgaagaggttgtgaaaaagatgaaaaattattggcgccagcttttaaacgcgaagctgatcacacaacgtaaattcgataatttgaccaaggctgaacggggtggcctgagcgagttagataaggcaggatttattaaacgccagttagtggagactcgtcaaatcaccaaacatgtcgcgcagattttggacagccggatgaacaccaagtacgatgaaaatgacaaactgatccgtgaggtgaaagtcattactctgaagtccaaattagttagtgatttccggaaggactttcaattctacaaagtccgtgaaattaataactatcatcacgcacatgacgcgtacctgaatgcagtggttgggaccgcccttatcaagaaatatcctaagctggagtcggagtttgtctatggcgactataaggtatacgatgttcgcaaaatgattgcgaaatctgagcaggagatcggtaaggcaaccgcaaaatatttcttttactcaaacattatgaatttctttaagacagaaatcactctggccaacggggagattcgcaaacgtccgttgatcgaaacaaacggcgagactggcgaaattgtttgggacaaagggcgtgatttcgcgacggtgcgcaaggtactgagcatgcctcaagtcaatattgttaagaaaaccgaagtgcagacgggcgggttttccaaggaaagcatcttacccaaacgtaattcagataaacttattgcacgcaaaaaggactgggatccgaaaaagtatggaggcttcgacagtccaaccgtagcctactctgttctcgttgtagcgaaagtagaaaagggtaaatccaagaaactgaaatctgtcaaggagttgcttggaatcaccattatggagcgtagctccttcgagaagaacccgattgactttctggaagccaaaggatataaagaggtcaagaaagatcttatcattaagctgcctaagtattcactcttcgagctggaaaatggtcgtaaacgcatgctcgcttctgccggcgagttgcagaagggcaatgaattagcacttccatcaaagtacgttaacttcctgtatttggccagccattacgagaaactgaaggggtctccagaggacaacgaacagaaacaattatttgtagagcagcacaagcattatcttgatgaaatcattgagcaaatttccgaattcagtaaacgcgtaatcctggccgatgcaaacctcgacaaggtgctgagcgcttacaataagcatcgcgacaaacctatccgtgagcaggctgaaaatatcattcacctgttcacattaacgaacctgggcgctccggccgcttttaaatatttcgacacgacaatcgaccgtaagcgctataccagtacgaaagaagtgttggatgcgacccttattcaccagtcaattacaggattatatgagacccgtatcgaccttagccaattaggtggggatggaggcggagggtcggaagcggcagcaaaaggaggcggaggaagtatggtgagcaaaggtgaagaggataatatggccatcatcaaagaattcatgcgcttcaaagttcatatggaaggtagcgttaatggccacgaatttgaaattgaaggtgaaggcgaaggtcgtccgtatgaaggcacccagaccgcaaaactgaaagttaccaaaggtggtccgctgccgtttgcatgggatattctgagtccgcagtttatgtatggtagcaaagcctatgttaaacatccggcagatatcccggattatctgaaactgagctttccggaaggttttaaatgggaacgtgtgatgaattttgaagatggtggtgttgttaccgttacacaggatagcagcctgcaggatggtgaatttatctataaagttaaactgcgtggcacgaattttccgagtgatggtccggttatgcagaaaaaaaccatgggttgggaagcaagcagcgaacgtatgtatccggaagatggcgcactgaaaggtgaaattaaacagcgtctgaagctgaaagatggcggtcattatgatgcagaagttaaaaccacctacaaagccaaaaaaccggttcagctgcctggtgcatataacgttaacattaaactggatatcaccagccacaacgaggattataccattgttgaacagtatgaacgtgcagaaggtcgccatagtaccggtggtatggatgaactgtataaa

SEQ ID NO: 371 - DNA, 4878 bp, Artificial Sequence
  SYNTHETIC
atggacaaaaagtactctattggcctggatatcgggaccaacagcgtcgggtgggctgttatcaccgacgagtataaagtaccttcgaaaaagttcaaagtgctgggcaacaccgatcgccattcaatcaaaaagaacttgattggtgcgctgttgtttgactccggggaaaccgccgaggcgactcgccttaaacgtacagcacgtcgccggtacactcggcgtaagaatcgcatttgctatttgcaggaaatctttagcaacgagatggcaaaagtcgatgactcgtttttccaccgcctcgaggaaagctttctggtggaggaagacaaaaagcatgagcgtcacccgatcttcggcaacattgtcgatgaagtagcgtatcatgaaaaatacccaaccatttaccacttacgcaaaaagctggtggacagcactgacaaagctgatttgcgccttatctatttagccctggcacatatgattaagtttcgtggtcacttcctgatcgaaggagacttaaatcccgacaacagtgatgttgataaattgtttattcagcttgtccaaacttacaatcaactgttcgaggaaaacccgatcaatgcctccggtgtggatgcaaaagccattttaagtgcacgccttagcaagtcccgtcgcttagaaaaccttatcgcgcagctgcccggcgagaaaaagaatggtttgtttgggaaccttattgccttgagcttaggcctcaccccgaatttcaaaagtaatttcgatcttgcagaagacgccaaattacaactgtcgaaggatacttatgatgacgatctcgataatctgttagcgcagattggtgaccaatacgccgatctttttctggcggctaaaaatctgagcgacgccatcttgctttcggatattctccgcgttaacaccgaaatcacgaaagcgcctcttagtgccagcatgattaaacgttatgatgaacaccaccaggacctgaccttactcaaagcgttggttcgccagcaactgccagagaagtacaaagaaatcttctttgatcagtcaaagaatggttatgccggctatattgacgggggtgcaagccaagaggaattctacaaatttatcaagcctattctggagaaaatggatggcaccgaagagttattggtgaagcttaaccgtgaagacctcctgcggaaacagcgcacattcgataatggttcgatcccacaccaaatccatttgggggagttacacgctattttgcgtcgccaggaagacttttaccctttcctgaaggataaccgggagaaaattgagaagatccttacctttcgtattccgtattacgtaggccccttagcacggggtaatagccgtttcgcgtggatgacacggaagtcggaagagacgatcaccccgtggaacttcgaagaggtagtcgacaagggcgcatcagcgcagtcttttattgaacgtatgacgaatttcgataaaaacttgcccaatgagaaggtgcttccgaaacattccttgttatatgaatattttacagtttacaacgagctgaccaaggttaaatacgtgacggaaggaatgcgcaagcccgcttttcttagcggtgagcaaaaaaaggcgatcgtcgacctgttattcaaaacgaatcgtaaggtgactgtaaagcaactcaaagaagattacttcaaaaagattgagtgcttcgacagcgtcgaaatctctggggtagaggatcggtttaacgcaagtttaggtacctaccatgacctgcttaaaatcattaaggataaagacttcttagataatgaagagaacgaagatattctcgaggacatcgtcttgacgttaaccttatttgaggatcgtgaaatgattgaggaacgcctcaaaacttatgcccacctgttcgacgataaggtgatgaagcagctgaaacgtcggcgctacacaggatggggccgcttgagtcgcaaacttattaacggaatccgtgacaagcaatccggcaaaacgattctggatttcttgaagtcggacggatttgctaatcgcaacttcatgcagttgatccatgatgactccctgacttttaaagaggatattcaaaaggcgcaggttagtggtcaaggcgacagcttacacgaacacatcgcaaatttggctggttcgccggccattaaaaaggggatcctccagaccgtgaaagttgtagatgagcttgttaaggtcatgggtcgtcataagcccgaaaacatcgtgattgaaatggcgcgggagaatcaaacgacccagaaaggacaaaagaatagccgtgaacggatgaagcggatcgaggaaggcattaaagagctggggtctcaaatcttgaaggaacaccctgtggagaacactcagctccaaaatgaaaaactttacctgtactatttgcagaacggacgcgatatgtacgtggaccaagagttggatattaatcggctgagtgactacgacgttgatcatatcgtcccgcagagcttcctcaaagacgattctattgacaataaggtactgacgcgctctgataaaaaccgtggtaagtcggacaacgtgccctccgaagaggttgtgaaaaagatgaaaaattattggcgccagcttttaaacgcgaagctgatcacacaacgtaaattcgataatttgaccaaggctgaacggggtggcctgagcgagttagataaggcaggatttattaaacgccagttagtggagactcgtcaaatcaccaaacatgtcgcgcagattttggacagccggatgaacaccaagtacgatgaaaatgacaaactgatccgtgaggtgaaagtcattactctgaagtccaaattagttagtgatttccggaaggactttcaattctacaaagtccgtgaaattaataactatcatcacgcacatgacgcgtacctgaatgcagtggttgggaccgcccttatcaagaaatatcctaagctggagtcggagtttgtctatggcgactataaggtatacgatgttcgcaaaatgattgcgaaatctgagcaggagatcggtaaggcaaccgcaaaatatttcttttactcaaacattatgaatttctttaagacagaaatcactctggccaacggggagattcgcaaacgtccgttgatcgaaacaaacggcgagactggcgaaattgtttgggacaaagggcgtgatttcgcgacggtgcgcaaggtactgagcatgcctcaagtcaatattgttaagaaaaccgaagtgcagacgggcgggttttccaaggaaagcatcttacccaaacgtaattcagataaacttattgcacgcaaaaaggactgggatccgaaaaagtatggaggcttcgacagtccaaccgtagcctactctgttctcgttgtagcgaaagtagaaaagggtaaatccaagaaactgaaatctgtcaaggagttgcttggaatcaccattatggagcgtagctccttcgagaagaacccgattgactttctggaagccaaaggatataaagaggtcaagaaagatcttatcattaagctgcctaagtattcactcttcgagctggaaaatggtcgtaaacgcatgctcgcttctgccggcgagttgcagaagggcaatgaattagcacttccatcaaagtacgttaacttcctgtatttggccagccattacgagaaactgaaggggtctccagaggacaacgaacagaaacaattatttgtagagcagcacaagcattatcttgatgaaatcattgagcaaatttccgaattcagtaaacgcgtaatcctggccgatgcaaacctcgacaaggtgctgagcgcttacaataagcatcgcgacaaacctatccgtgagcaggctgaaaatatcattcacctgttcacattaacgaacctgggcgctccggccgcttttaaatatttcgacacgacaatcgaccgtaagcgctataccagtacgaaagaagtgttggatgcgacccttattcaccagtcaattacaggattatatgagacccgtatcgaccttagccaattaggtggggatgctgaggccgcagcaaaagaggctgccgctaaggaggctgctgcaaaagaagcagcagcgaaagctatggtgagcaaaggtgaagaggataatatggccatcatcaaagaattcatgcgcttcaaagttcatatggaaggtagcgttaatggccacgaatttgaaattgaaggtgaaggcgaaggtcgtccgtatgaaggcacccagaccgcaaaactgaaagttaccaaaggtggtccgctgccgtttgcatgggatattctgagtccgcagtttatgtatggtagcaaagcctatgttaaacatccggcagatatcccggattatctgaaactgagctttccggaaggttttaaatgggaacgtgtgatgaattttgaagatggtggtgttgttaccgttacacaggatagcagcctgcaggatggtgaatttatctataaagttaaactgcgtggcacgaattttccgagtgatggtccggttatgcagaaaaaaaccatgggttgggaagcaagcagcgaacgtatgtatccggaagatggcgcactgaaaggtgaaattaaacagcgtctgaagctgaaagatggcggtcattatgatgcagaagttaaaaccacctacaaagccaaaaaaccggttcagctgcctggtgcatataacgttaacattaaactggatatcaccagccacaacgaggattataccattgttgaacagtatgaacgtgcagaaggtcgccatagtaccggtggtatggatgaactgtataaa

SEQ ID NO: 372 - DNA, 4950 bp, Artificial Sequence
  SYNTHETIC
atggacaaaaagtactctattggcctggatatcgggaccaacagcgtcgggtgggctgttatcaccgacgagtataaagtaccttcgaaaaagttcaaagtgctgggcaacaccgatcgccattcaatcaaaaagaacttgattggtgcgctgttgtttgactccggggaaaccgccgaggcgactcgccttaaacgtacagcacgtcgccggtacactcggcgtaagaatcgcatttgctatttgcaggaaatctttagcaacgagatggcaaaagtcgatgactcgtttttccaccgcctcgaggaaagctttctggtggaggaagacaaaaagcatgagcgtcacccgatcttcggcaacattgtcgatgaagtagcgtatcatgaaaaatacccaaccatttaccacttacgcaaaaagctggtggacagcactgacaaagctgatttgcgccttatctatttagccctggcacatatgattaagtttcgtggtcacttcctgatcgaaggagacttaaatcccgacaacagtgatgttgataaattgtttattcagcttgtccaaacttacaatcaactgttcgaggaaaacccgatcaatgcctccggtgtggatgcaaaagccattttaagtgcacgccttagcaagtcccgtcgcttagaaaaccttatcgcgcagctgcccggcgagaaaaagaatggtttgtttgggaaccttattgccttgagcttaggcctcaccccgaatttcaaaagtaatttcgatcttgcagaagacgccaaattacaactgtcgaaggatacttatgatgacgatctcgataatctgttagcgcagattggtgaccaatacgccgatctttttctggcggctaaaaatctgagcgacgccatcttgctttcggatattctccgcgttaacaccgaaatcacgaaagcgcctcttagtgccagcatgattaaacgttatgatgaacaccaccaggacctgaccttactcaaagcgttggttcgccagcaactgccagagaagtacaaagaaatcttctttgatcagtcaaagaatggttatgccggctatattgacgggggtgcaagccaagaggaattctacaaatttatcaagcctattctggagaaaatggatggcaccgaagagttattggtgaagcttaaccgtgaagacctcctgcggaaacagcgcacattcgataatggttcgatcccacaccaaatccatttgggggagttacacgctattttgcgtcgccaggaagacttttaccctttcctgaaggataaccgggagaaaattgagaagatccttacctttcgtattccgtattacgtaggccccttagcacggggtaatagccgtttcgcgtggatgacacggaagtcggaagagacgatcaccccgtggaacttcgaagaggtagtcgacaagggcgcatcagcgcagtcttttattgaacgtatgacgaatttcgataaaaacttgcccaatgagaaggtgcttccgaaacattccttgttatatgaatattttacagtttacaacgagctgaccaaggttaaatacgtgacggaaggaatgcgcaagcccgcttttcttagcggtgagcaaaaaaaggcgatcgtcgacctgttattcaaaacgaatcgtaaggtgactgtaaagcaactcaaagaagattacttcaaaaagattgagtgcttcgacagcgtcgaaatctctggggtagaggatcggtttaacgcaagtttaggtacctaccatgacctgcttaaaatcattaaggataaagacttcttagataatgaagagaacgaagatattctcgaggacatcgtcttgacgttaaccttatttgaggatcgtgaaatgattgaggaacgcctcaaaacttatgcccacctgttcgacgataaggtgatgaagcagctgaaacgtcggcgctacacaggatggggccgcttgagtcgcaaacttattaacggaatccgtgacaagcaatccggcaaaacgattctggatttcttgaagtcggacggatttgctaatcgcaacttcatgcagttgatccatgatgactccctgacttttaaagaggatattcaaaaggcgcaggttagtggtcaaggcgacagcttacacgaacacatcgcaaatttggctggttcgccggccattaaaaaggggatcctccagaccgtgaaagttgtagatgagcttgttaaggtcatgggtcgtcataagcccgaaaacatcgtgattgaaatggcgcgggagaatcaaacgacccagaaaggacaaaagaatagccgtgaacggatgaagcggatcgaggaaggcattaaagagctggggtctcaaatcttgaaggaacaccctgtggagaacactcagctccaaaatgaaaaactttacctgtactatttgcagaacggacgcgatatgtacgtggaccaagagttggatattaatcggctgagtgactacgacgttgatcatatcgtcccgcagagcttcctcaaagacgattctattgacaataaggtactgacgcgctctgataaaaaccgtggtaagtcggacaacgtgccctccgaagaggttgtgaaaaagatgaaaaattattggcgccagcttttaaacgcgaagctgatcacacaacgtaaattcgataatttgaccaaggctgaacggggtggcctgagcgagttagataaggcaggatttattaaacgccagttagtggagactcgtcaaatcaccaaacatgtcgcgcagattttggacagccggatgaacaccaagtacgatgaaaatgacaaactgatccgtgaggtgaaagtcattactctgaagtccaaattagttagtgatttccggaaggactttcaattctacaaagtccgtgaaattaataactatcatcacgcacatgacgcgtacctgaatgcagtggttgggaccgcccttatcaagaaatatcctaagctggagtcggagtttgtctatggcgactataaggtatacgatgttcgcaaaatgattgcgaaatctgagcaggagatcggtaaggcaaccgcaaaatatttcttttactcaaacattatgaatttctttaagacagaaatcactctggccaacggggagattcgcaaacgtccgttgatcgaaacaaacggcgagactggcgaaattgtttgggacaaagggcgtgatttcgcgacggtgcgcaaggtactgagcatgcctcaagtcaatattgttaagaaaaccgaagtgcagacgggcgggttttccaaggaaagcatcttacccaaacgtaattcagataaacttattgcacgcaaaaaggactgggatccgaaaaagtatggaggcttcgacagtccaaccgtagcctactctgttctcgttgtagcgaaagtagaaaagggtaaatccaagaaactgaaatctgtcaaggagttgcttggaatcaccattatggagcgtagctccttcgagaagaacccgattgactttctggaagccaaaggatataaagaggtcaagaaagatcttatcattaagctgcctaagtattcactcttcgagctggaaaatggtcgtaaacgcatgctcgcttctgccggcgagttgcagaagggcaatgaattagcacttccatcaaagtacgttaacttcctgtatttggccagccattacgagaaactgaaggggtctccagaggacaacgaacagaaacaattatttgtagagcagcacaagcattatcttgatgaaatcattgagcaaatttccgaattcagtaaacgcgtaatcctggccgatgcaaacctcgacaaggtgctgagcgcttacaataagcatcgcgacaaacctatccgtgagcaggctgaaaatatcattcacctgttcacattaacgaacctgggcgctccggccgcttttaaatatttcgacacgacaatcgaccgtaagcgctataccagtacgaaagaagtgttggatgcgacccttattcaccagtcaattacaggattatatgagacccgtatcgaccttagccaattaggtggggatgccgaagcagcagccaaagaagctgccgcaaaggaggcggcagctaaagaagcggccgctaaggcattggaagcggaggcggctgccaaggaggctgcggcgaaagaagctgcggccaaagaagcggctgcaaaagcgatggtgagcaaaggtgaagaggataatatggccatcatcaaagaattcatgcgcttcaaagttcatatggaaggtagcgttaatggccacgaatttgaaattgaaggtgaaggcgaaggtcgtccgtatgaaggcacccagaccgcaaaactgaaagttaccaaaggtggtccgctgccgtttgcatgggatattctgagtccgcagtttatgtatggtagcaaagcctatgttaaacatccggcagatatcccggattatctgaaactgagctttccggaaggttttaaatgggaacgtgtgatgaattttgaagatggtggtgttgttaccgttacacaggatagcagcctgcaggatggtgaatttatctataaagttaaactgcgtggcacgaattttccgagtgatggtccggttatgcagaaaaaaaccatgggttgggaagcaagcagcgaacgtatgtatccggaagatggcgcactgaaaggtgaaattaaacagcgtctgaagctgaaagatggcggtcattatgatgcagaagttaaaaccacctacaaagccaaaaaaccggttcagctgcctggtgcatataacgttaacattaaactggatatcaccagccacaacgaggattataccattgttgaacagtatgaacgtgcagaaggtcgccatagtaccggtggtatggatgaactgtataaa

SEQ ID NO: 373 - DNA, 4962 bp, Artificial Sequence
  SYNTHETIC
atggacaaaaagtactctattggcctggatatcgggaccaacagcgtcgggtgggctgttatcaccgacgagtataaagtaccttcgaaaaagttcaaagtgctgggcaacaccgatcgccattcaatcaaaaagaacttgattggtgcgctgttgtttgactccggggaaaccgccgaggcgactcgccttaaacgtacagcacgtcgccggtacactcggcgtaagaatcgcatttgctatttgcaggaaatctttagcaacgagatggcaaaagtcgatgactcgtttttccaccgcctcgaggaaagctttctggtggaggaagacaaaaagcatgagcgtcacccgatcttcggcaacattgtcgatgaagtagcgtatcatgaaaaatacccaaccatttaccacttacgcaaaaagctggtggacagcactgacaaagctgatttgcgccttatctatttagccctggcacatatgattaagtttcgtggtcacttcctgatcgaaggagacttaaatcccgacaacagtgatgttgataaattgtttattcagcttgtccaaacttacaatcaactgttcgaggaaaacccgatcaatgcctccggtgtggatgcaaaagccattttaagtgcacgccttagcaagtcccgtcgcttagaaaaccttatcgcgcagctgcccggcgagaaaaagaatggtttgtttgggaaccttattgccttgagcttaggcctcaccccgaatttcaaaagtaatttcgatcttgcagaagacgccaaattacaactgtcgaaggatacttatgatgacgatctcgataatctgttagcgcagattggtgaccaatacgccgatctttttctggcggctaaaaatctgagcgacgccatcttgctttcggatattctccgcgttaacaccgaaatcacgaaagcgcctcttagtgccagcatgattaaacgttatgatgaacaccaccaggacctgaccttactcaaagcgttggttcgccagcaactgccagagaagtacaaagaaatcttctttgatcagtcaaagaatggttatgccggctatattgacgggggtgcaagccaagaggaattctacaaatttatcaagcctattctggagaaaatggatggcaccgaagagttattggtgaagcttaaccgtgaagacctcctgcggaaacagcgcacattcgataatggttcgatcccacaccaaatccatttgggggagttacacgctattttgcgtcgccaggaagacttttaccctttcctgaaggataaccgggagaaaattgagaagatccttacctttcgtattccgtattacgtaggccccttagcacggggtaatagccgtttcgcgtggatgacacggaagtcggaagagacgatcaccccgtggaacttcgaagaggtagtcgacaagggcgcatcagcgcagtcttttattgaacgtatgacgaatttcgataaaaacttgcccaatgagaaggtgcttccgaaacattccttgttatatgaatattttacagtttacaacgagctgaccaaggttaaatacgtgacggaaggaatgcgcaagcccgcttttcttagcggtgagcaaaaaaaggcgatcgtcgacctgttattcaaaacgaatcgtaaggtgactgtaaagcaactcaaagaagattacttcaaaaagattgagtgcttcgacagcgtcgaaatctctggggtagaggatcggtttaacgcaagtttaggtacctaccatgacctgcttaaaatcattaaggataaagacttcttagataatgaagagaacgaagatattctcgaggacatcgtcttgacgttaaccttatttgaggatcgtgaaatgattgaggaacgcctcaaaacttatgcccacctgttcgacgataaggtgatgaagcagctgaaacgtcggcgctacacaggatggggccgcttgagtcgcaaacttattaacggaatccgtgacaagcaatccggcaaaacgattctggatttcttgaagtcggacggatttgctaatcgcaacttcatgcagttgatccatgatgactccctgacttttaaagaggatattcaaaaggcgcaggttagtggtcaaggcgacagcttacacgaacacatcgcaaatttggctggttcgccggccattaaaaaggggatcctccagaccgtgaaagttgtagatgagcttgttaaggtcatgggtcgtcataagcccgaaaacatcgtgattgaaatggcgcgggagaatcaaacgacccagaaaggacaaaagaatagccgtgaacggatgaagcggatcgaggaaggcattaaagagctggggtctcaaatcttgaaggaacaccctgtggagaacactcagctccaaaatgaaaaactttacctgtactatttgcagaacggacgcgatatgtacgtggaccaagagttggatattaatcggctgagtgactacgacgttgatcatatcgtcccgcagagcttcctcaaagacgattctattgacaataaggtactgacgcgctctgataaaaaccgtggtaagtcggacaacgtgccctccgaagaggttgtgaaaaagatgaaaaattattggcgccagcttttaaacgcgaagctgatcacacaacgtaaattcgataatttgaccaaggctgaacggggtggcctgagcgagttagataaggcaggatttattaaacgccagttagtggagactcgtcaaatcaccaaacatgtcgcgcagattttggacagccggatgaacaccaagtacgatgaaaatgacaaactgatccgtgaggtgaaagtcattactctgaagtccaaattagttagtgatttccggaaggactttcaattctacaaagtccgtgaaattaataactatcatcacgcacatgacgcgtacctgaatgcagtggttgggaccgcccttatcaagaaatatcctaagctggagtcggagtttgtctatggcgactataaggtatacgatgttcgcaaaatgattgcgaaatctgagcaggagatcggtaaggcaaccgcaaaatatttcttttactcaaacattatgaatttctttaagacagaaatcactctggccaacggggagattcgcaaacgtccgttgatcgaaacaaacggcgagactggcgaaattgtttgggacaaagggcgtgatttcgcgacggtgcgcaaggtactgagcatgcctcaagtcaatattgttaagaaaaccgaagtgcagacgggcgggttttccaaggaaagcatcttacccaaacgtaattcagataaacttattgcacgcaaaaaggactgggatccgaaaaagtatggaggcttcgacagtccaaccgtagcctactctgttctcgttgtagcgaaagtagaaaagggtaaatccaagaaactgaaatctgtcaaggagttgcttggaatcaccattatggagcgtagctccttcgagaagaacccgattgactttctggaagccaaaggatataaagaggtcaagaaagatcttatcattaagctgcctaagtattcactcttcgagctggaaaatggtcgtaaacgcatgctcgcttctgccggcgagttgcagaagggcaatgaattagcacttccatcaaagtacgttaacttcctgtatttggccagccattacgagaaactgaaggggtctccagaggacaacgaacagaaacaattatttgtagagcagcacaagcattatcttgatgaaatcattgagcaaatttccgaattcagtaaacgcgtaatcctggccgatgcaaacctcgacaaggtgctgagcgcttacaataagcatcgcgacaaacctatccgtgagcaggctgaaaatatcattcacctgttcacattaacgaacctgggcgctccggccgcttttaaatatttcgacacgacaatcgaccgtaagcgctataccagtacgaaagaagtgttggatgcgacccttattcaccagtcaattacaggattatatgagacccgtatcgaccttagccaattaggtggggatttagaggctgaggctgctgccaaggaggctgctgcgaaggaagctgcagctaaagaggcagcggccaaagcacttgaggccgaagccgccgcgaaagaagccgctgctaaggaggcagccgccaaagaagcggcagctaaagcattagaaatggtgagcaaaggtgaagaggataatatggccatcatcaaagaattcatgcgcttcaaagttcatatggaaggtagcgttaatggccacgaatttgaaattgaaggtgaaggcgaaggtcgtccgtatgaaggcacccagaccgcaaaactgaaagttaccaaaggtggtccgctgccgtttgcatgggatattctgagtccgcagtttatgtatggtagcaaagcctatgttaaacatccggcagatatcccggattatctgaaactgagctttccggaaggttttaaatgggaacgtgtgatgaattttgaagatggtggtgttgttaccgttacacaggatagcagcctgcaggatggtgaatttatctataaagttaaactgcgtggcacgaattttccgagtgatggtccggttatgcagaaaaaaaccatgggttgggaagcaagcagcgaacgtatgtatccggaagatggcgcactgaaaggtgaaattaaacagcgtctgaagctgaaagatggcggtcattatgatgcagaagttaaaaccacctacaaagccaaaaaaccggttcagctgcctggtgcatataacgttaacattaaactggatatcaccagccacaacgaggattataccattgttgaacagtatgaacgtgcagaaggtcgccatagtaccggtggtatggatgaactgtataaa

SEQ ID NO: 374 - DNA, 4821 bp, Artificial Sequence
  SYNTHETIC
atggacaaaaagtactctattggcctggatatcgggaccaacagcgtcgggtgggctgttatcaccgacgagtataaagtaccttcgaaaaagttcaaagtgctgggcaacaccgatcgccattcaatcaaaaagaacttgattggtgcgctgttgtttgactccggggaaaccgccgaggcgactcgccttaaacgtacagcacgtcgccggtacactcggcgtaagaatcgcatttgctatttgcaggaaatctttagcaacgagatggcaaaagtcgatgactcgtttttccaccgcctcgaggaaagctttctggtggaggaagacaaaaagcatgagcgtcacccgatcttcggcaacattgtcgatgaagtagcgtatcatgaaaaatacccaaccatttaccacttacgcaaaaagctggtggacagcactgacaaagctgatttgcgccttatctatttagccctggcacatatgattaagtttcgtggtcacttcctgatcgaaggagacttaaatcccgacaacagtgatgttgataaattgtttattcagcttgtccaaacttacaatcaactgttcgaggaaaacccgatcaatgcctccggtgtggatgcaaaagccattttaagtgcacgccttagcaagtcccgtcgcttagaaaaccttatcgcgcagctgcccggcgagaaaaagaatggtttgtttgggaaccttattgccttgagcttaggcctcaccccgaatttcaaaagtaatttcgatcttgcagaagacgccaaattacaactgtcgaaggatacttatgatgacgatctcgataatctgttagcgcagattggtgaccaatacgccgatctttttctggcggctaaaaatctgagcgacgccatcttgctttcggatattctccgcgttaacaccgaaatcacgaaagcgcctcttagtgccagcatgattaaacgttatgatgaacaccaccaggacctgaccttactcaaagcgttggttcgccagcaactgccagagaagtacaaagaaatcttctttgatcagtcaaagaatggttatgccggctatattgacgggggtgcaagccaagaggaattctacaaatttatcaagcctattctggagaaaatggatggcaccgaagagttattggtgaagcttaaccgtgaagacctcctgcggaaacagcgcacattcgataatggttcgatcccacaccaaatccatttgggggagttacacgctattttgcgtcgccaggaagacttttaccctttcctgaaggataaccgggagaaaattgagaagatccttacctttcgtattccgtattacgtaggccccttagcacggggtaatagccgtttcgcgtggatgacacggaagtcggaagagacgatcaccccgtggaacttcgaagaggtagtcgacaagggcgcatcagcgcagtcttttattgaacgtatgacgaatttcgataaaaacttgcccaatgagaaggtgcttccgaaacattccttgttatatgaatattttacagtttacaacgagctgaccaaggttaaatacgtgacggaaggaatgcgcaagcccgcttttcttagcggtgagcaaaaaaaggcgatcgtcgacctgttattcaaaacgaatcgtaaggtgactgtaaagcaactcaaagaagattacttcaaaaagattgagtgcttcgacagcgtcgaaatctctggggtagaggatcggtttaacgcaagtttaggtacctaccatgacctgcttaaaatcattaaggataaagacttcttagataatgaagagaacgaagatattctcgaggacatcgtcttgacgttaaccttatttgaggatcgtgaaatgattgaggaacgcctcaaaacttatgcccacctgttcgacgataaggtgatgaagcagctgaaacgtcggcgctacacaggatggggccgcttgagtcgcaaacttattaacggaatccgtgacaagcaatccggcaaaacgattctggatttcttgaagtcggacggatttgctaatcgcaacttcatgcagttgatccatgatgactccctgacttttaaagaggatattcaaaaggcgcaggttagtggtcaaggcgacagcttacacgaacacatcgcaaatttggctggttcgccggccattaaaaaggggatcctccagaccgtgaaagttgtagatgagcttgttaaggtcatgggtcgtcataagcccgaaaacatcgtgattgaaatggcgcgggagaatcaaacgacccagaaaggacaaaagaatagccgtgaacggatgaagcggatcgaggaaggcattaaagagctggggtctcaaatcttgaaggaacaccctgtggagaacactcagctccaaaatgaaaaactttacctgtactatttgcagaacggacgcgatatgtacgtggaccaagagttggatattaatcggctgagtgactacgacgttgatcatatcgtcccgcagagcttcctcaaagacgattctattgacaataaggtactgacgcgctctgataaaaaccgtggtaagtcggacaacgtgccctccgaagaggttgtgaaaaagatgaaaaattattggcgccagcttttaaacgcgaagctgatcacacaacgtaaattcgataatttgaccaaggctgaacggggtggcctgagcgagttagataaggcaggatttattaaacgccagttagtggagactcgtcaaatcaccaaacatgtcgcgcagattttggacagccggatgaacaccaagtacgatgaaaatgacaaactgatccgtgaggtgaaagtcattactctgaagtccaaattagttagtgatttccggaaggactttcaattctacaaagtccgtgaaattaataactatcatcacgcacatgacgcgtacctgaatgcagtggttgggaccgcccttatcaagaaatatcctaagctggagtcggagtttgtctatggcgactataaggtatacgatgttcgcaaaatgattgcgaaatctgagcaggagatcggtaaggcaaccgcaaaatatttcttttactcaaacattatgaatttctttaagacagaaatcactctggccaacggggagattcgcaaacgtccgttgatcgaaacaaacggcgagactggcgaaattgtttgggacaaagggcgtgatttcgcgacggtgcgcaaggtactgagcatgcctcaagtcaatattgttaagaaaaccgaagtgcagacgggcgggttttccaaggaaagcatcttacccaaacgtaattcagataaacttattgcacgcaaaaaggactgggatccgaaaaagtatggaggcttcgacagtccaaccgtagcctactctgttctcgttgtagcgaaagtagaaaagggtaaatccaagaaactgaaatctgtcaaggagttgcttggaatcaccattatggagcgtagctccttcgagaagaacccgattgactttctggaagccaaaggatataaagaggtcaagaaagatcttatcattaagctgcctaagtattcactcttcgagctggaaaatggtcgtaaacgcatgctcgcttctgccggcgagttgcagaagggcaatgaattagcacttccatcaaagtacgttaacttcctgtatttggccagccattacgagaaactgaaggggtctccagaggacaacgaacagaaacaattatttgtagagcagcacaagcattatcttgatgaaatcattgagcaaatttccgaattcagtaaacgcgtaatcctggccgatgcaaacctcgacaaggtgctgagcgcttacaataagcatcgcgacaaacctatccgtgagcaggctgaaaatatcattcacctgttcacattaacgaacctgggcgctccggccgcttttaaatatttcgacacgacaatcgaccgtaagcgctataccagtacgaaagaagtgttggatgcgacccttattcaccagtcaattacaggattatatgagacccgtatcgaccttagccaattaggtggggatgcacctgcgatggtgagcaaaggtgaagaggataatatggccatcatcaaagaattcatgcgcttcaaagttcatatggaaggtagcgttaatggccacgaatttgaaattgaaggtgaaggcgaaggtcgtccgtatgaaggcacccagaccgcaaaactgaaagttaccaaaggtggtccgctgccgtttgcatgggatattctgagtccgcagtttatgtatggtagcaaagcctatgttaaacatccggcagatatcccggattatctgaaactgagctttccggaaggttttaaatgggaacgtgtgatgaattttgaagatggtggtgttgttaccgttacacaggatagcagcctgcaggatggtgaatttatctataaagttaaactgcgtggcacgaattttccgagtgatggtccggttatgcagaaaaaaaccatgggttgggaagcaagcagcgaacgtatgtatccggaagatggcgcactgaaaggtgaaattaaacagcgtctgaagctgaaagatggcggtcattatgatgcagaagttaaaaccacctacaaagccaaaaaaccggttcagctgcctggtgcatataacgttaacattaaactggatatcaccagccacaacgaggattataccattgttgaacagtatgaacgtgcagaaggtcgccatagtaccggtggtatggatgaactgtataaa

SEQ ID NO: 375 - DNA, 4827 bp, Artificial Sequence
  SYNTHETIC
atggacaaaaagtactctattggcctggatatcgggaccaacagcgtcgggtgggctgttatcaccgacgagtataaagtaccttcgaaaaagttcaaagtgctgggcaacaccgatcgccattcaatcaaaaagaacttgattggtgcgctgttgtttgactccggggaaaccgccgaggcgactcgccttaaacgtacagcacgtcgccggtacactcggcgtaagaatcgcatttgctatttgcaggaaatctttagcaacgagatggcaaaagtcgatgactcgtttttccaccgcctcgaggaaagctttctggtggaggaagacaaaaagcatgagcgtcacccgatcttcggcaacattgtcgatgaagtagcgtatcatgaaaaatacccaaccatttaccacttacgcaaaaagctggtggacagcactgacaaagctgatttgcgccttatctatttagccctggcacatatgattaagtttcgtggtcacttcctgatcgaaggagacttaaatcccgacaacagtgatgttgataaattgtttattcagcttgtccaaacttacaatcaactgttcgaggaaaacccgatcaatgcctccggtgtggatgcaaaagccattttaagtgcacgccttagcaagtcccgtcgcttagaaaaccttatcgcgcagctgcccggcgagaaaaagaatggtttgtttgggaaccttattgccttgagcttaggcctcaccccgaatttcaaaagtaatttcgatcttgcagaagacgccaaattacaactgtcgaaggatacttatgatgacgatctcgataatctgttagcgcagattggtgaccaatacgccgatctttttctggcggctaaaaatctgagcgacgccatcttgctttcggatattctccgcgttaacaccgaaatcacgaaagcgcctcttagtgccagcatgattaaacgttatgatgaacaccaccaggacctgaccttactcaaagcgttggttcgccagcaactgccagagaagtacaaagaaatcttctttgatcagtcaaagaatggttatgccggctatattgacgggggtgcaagccaagaggaattctacaaatttatcaagcctattctggagaaaatggatggcaccgaagagttattggtgaagcttaaccgtgaagacctcctgcggaaacagcgcacattcgataatggttcgatcccacaccaaatccatttgggggagttacacgctattttgcgtcgccaggaagacttttaccctttcctgaaggataaccgggagaaaattgagaagatccttacctttcgtattccgtattacgtaggccccttagcacggggtaatagccgtttcgcgtggatgacacggaagtcggaagagacgatcaccccgtggaacttcgaagaggtagtcgacaagggcgcatcagcgcagtcttttattgaacgtatgacgaatttcgataaaaacttgcccaatgagaaggtgcttccgaaacattccttgttatatgaatattttacagtttacaacgagctgaccaaggttaaatacgtgacggaaggaatgcgcaagcccgcttttcttagcggtgagcaaaaaaaggcgatcgtcgacctgttattcaaaacgaatcgtaaggtgactgtaaagcaactcaaagaagattacttcaaaaagattgagtgcttcgacagcgtcgaaatctctggggtagaggatcggtttaacgcaagtttaggtacctaccatgacctgcttaaaatcattaaggataaagacttcttagataatgaagagaacgaagatattctcgaggacatcgtcttgacgttaaccttatttgaggatcgtgaaatgattgaggaacgcctcaaaacttatgcccacctgttcgacgataaggtgatgaagcagctgaaacgtcggcgctacacaggatggggccgcttgagtcgcaaacttattaacggaatccgtgacaagcaatccggcaaaacgattctggatttcttgaagtcggacggatttgctaatcgcaacttcatgcagttgatccatgatgactccctgacttttaaagaggatattcaaaaggcgcaggttagtggtcaaggcgacagcttacacgaacacatcgcaaatttggctggttcgccggccattaaaaaggggatcctccagaccgtgaaagttgtagatgagcttgttaaggtcatgggtcgtcataagcccgaaaacatcgtgattgaaatggcgcgggagaatcaaacgacccagaaaggacaaaagaatagccgtgaacggatgaagcggatcgaggaaggcattaaagagctggggtctcaaatcttgaaggaacaccctgtggagaacactcagctccaaaatgaaaaactttacctgtactatttgcagaacggacgcgatatgtacgtggaccaagagttggatattaatcggctgagtgactacgacgttgatcatatcgtcccgcagagcttcctcaaagacgattctattgacaataaggtactgacgcgctctgataaaaaccgtggtaagtcggacaacgtgccctccgaagaggttgtgaaaaagatgaaaaattattggcgccagcttttaaacgcgaagctgatcacacaacgtaaattcgataatttgaccaaggctgaacggggtggcctgagcgagttagataaggcaggatttattaaacgccagttagtggagactcgtcaaatcaccaaacatgtcgcgcagattttggacagccggatgaacaccaagtacgatgaaaatgacaaactgatccgtgaggtgaaagtcattactctgaagtccaaattagttagtgatttccggaaggactttcaattctacaaagtccgtgaaattaataactatcatcacgcacatgacgcgtacctgaatgcagtggttgggaccgcccttatcaagaaatatcctaagctggagtcggagtttgtctatggcgactataaggtatacgatgttcgcaaaatgattgcgaaatctgagcaggagatcggtaaggcaaccgcaaaatatttcttttactcaaacattatgaatttctttaagacagaaatcactctggccaacggggagattcgcaaacgtccgttgatcgaaacaaacggcgagactggcgaaattgtttgggacaaagggcgtgatttcgcgacggtgcgcaaggtactgagcatgcctcaagtcaatattgttaagaaaaccgaagtgcagacgggcgggttttccaaggaaagcatcttacccaaacgtaattcagataaacttattgcacgcaaaaaggactgggatccgaaaaagtatggaggcttcgacagtccaaccgtagcctactctgttctcgttgtagcgaaagtagaaaagggtaaatccaagaaactgaaatctgtcaaggagttgcttggaatcaccattatggagcgtagctccttcgagaagaacccgattgactttctggaagccaaaggatataaagaggtcaagaaagatcttatcattaagctgcctaagtattcactcttcgagctggaaaatggtcgtaaacgcatgctcgcttctgccggcgagttgcagaagggcaatgaattagcacttccatcaaagtacgttaacttcctgtatttggccagccattacgagaaactgaaggggtctccagaggacaacgaacagaaacaattatttgtagagcagcacaagcattatcttgatgaaatcattgagcaaatttccgaattcagtaaacgcgtaatcctggccgatgcaaacctcgacaaggtgctgagcgcttacaataagcatcgcgacaaacctatccgtgagcaggctgaaaatatcattcacctgttcacattaacgaacctgggcgctccggccgcttttaaatatttcgacacgacaatcgaccgtaagcgctataccagtacgaaagaagtgttggatgcgacccttattcaccagtcaattacaggattatatgagacccgtatcgaccttagccaattaggtggggatgctcctgcacctgcgatggtgagcaaaggtgaagaggataatatggccatcatcaaagaattcatgcgcttcaaagttcatatggaaggtagcgttaatggccacgaatttgaaattgaaggtgaaggcgaaggtcgtccgtatgaaggcacccagaccgcaaaactgaaagttaccaaaggtggtccgctgccgtttgcatgggatattctgagtccgcagtttatgtatggtagcaaagcctatgttaaacatccggcagatatcccggattatctgaaactgagctttccggaaggttttaaatgggaacgtgtgatgaattttgaagatggtggtgttgttaccgttacacaggatagcagcctgcaggatggtgaatttatctataaagttaaactgcgtggcacgaattttccgagtgatggtccggttatgcagaaaaaaaccatgggttgggaagcaagcagcgaacgtatgtatccggaagatggcgcactgaaaggtgaaattaaacagcgtctgaagctgaaagatggcggtcattatgatgcagaagttaaaaccacctacaaagccaaaaaaccggttcagctgcctggtgcatataacgttaacattaaactggatatcaccagccacaacgaggattataccattgttgaacagtatgaacgtgcagaaggtcgccatagtaccggtggtatggatgaactgtataaa

SEQ ID NO: 376 - DNA, 4833 bp, Artificial Sequence
  SYNTHETIC
atggacaaaaagtactctattggcctggatatcgggaccaacagcgtcgggtgggctgttatcaccgacgagtataaagtaccttcgaaaaagttcaaagtgctgggcaacaccgatcgccattcaatcaaaaagaacttgattggtgcgctgttgtttgactccggggaaaccgccgaggcgactcgccttaaacgtacagcacgtcgccggtacactcggcgtaagaatcgcatttgctatttgcaggaaatctttagcaacgagatggcaaaagtcgatgactcgtttttccaccgcctcgaggaaagctttctggtggaggaagacaaaaagcatgagcgtcacccgatcttcggcaacattgtcgatgaagtagcgtatcatgaaaaatacccaaccatttaccacttacgcaaaaagctggtggacagcactgacaaagctgatttgcgccttatctatttagccctggcacatatgattaagtttcgtggtcacttcctgatcgaaggagacttaaatcccgacaacagtgatgttgataaattgtttattcagcttgtccaaacttacaatcaactgttcgaggaaaacccgatcaatgcctccggtgtggatgcaaaagccattttaagtgcacgccttagcaagtcccgtcgcttagaaaaccttatcgcgcagctgcccggcgagaaaaagaatggtttgtttgggaaccttattgccttgagcttaggcctcaccccgaatttcaaaagtaatttcgatcttgcagaagacgccaaattacaactgtcgaaggatacttatgatgacgatctcgataatctgttagcgcagattggtgaccaatacgccgatctttttctggcggctaaaaatctgagcgacgccatcttgctttcggatattctccgcgttaacaccgaaatcacgaaagcgcctcttagtgccagcatgattaaacgttatgatgaacaccaccaggacctgaccttactcaaagcgttggttcgccagcaactgccagagaagtacaaagaaatcttctttgatcagtcaaagaatggttatgccggctatattgacgggggtgcaagccaagaggaattctacaaatttatcaagcctattctggagaaaatggatggcaccgaagagttattggtgaagcttaaccgtgaagacctcctgcggaaacagcgcacattcgataatggttcgatcccacaccaaatccatttgggggagttacacgctattttgcgtcgccaggaagacttttaccctttcctgaaggataaccgggagaaaattgagaagatccttacctttcgtattccgtattacgtaggccccttagcacggggtaatagccgtttcgcgtggatgacacggaagtcggaagagacgatcaccccgtggaacttcgaagaggtagtcgacaagggcgcatcagcgcagtcttttattgaacgtatgacgaatttcgataaaaacttgcccaatgagaaggtgcttccgaaacattccttgttatatgaatattttacagtttacaacgagctgaccaaggttaaatacgtgacggaaggaatgcgcaagcccgcttttcttagcggtgagcaaaaaaaggcgatcgtcgacctgttattcaaaacgaatcgtaaggtgactgtaaagcaactcaaagaagattacttcaaaaagattgagtgcttcgacagcgtcgaaatctctggggtagaggatcggtttaacgcaagtttaggtacctaccatgacctgcttaaaatcattaaggataaagacttcttagataatgaagagaacgaagatattctcgaggacatcgtcttgacgttaaccttatttgaggatcgtgaaatgattgaggaacgcctcaaaacttatgcccacctgttcgacgataaggtgatgaagcagctgaaacgtcggcgctacacaggatggggccgcttgagtcgcaaacttattaacggaatccgtgacaagcaatccggcaaaacgattctggatttcttgaagtcggacggatttgctaatcgcaacttcatgcagttgatccatgatgactccctgacttttaaagaggatattcaaaaggcgcaggttagtggtcaaggcgacagcttacacgaacacatcgcaaatttggctggttcgccggccattaaaaaggggatcctccagaccgtgaaagttgtagatgagcttgttaaggtcatgggtcgtcataagcccgaaaacatcgtgattgaaatggcgcgggagaatcaaacgacccagaaaggacaaaagaatagccgtgaacggatgaagcggatcgaggaaggcattaaagagctggggtctcaaatcttgaaggaacaccctgtggagaacactcagctccaaaatgaaaaactttacctgtactatttgcagaacggacgcgatatgtacgtggaccaagagttggatattaatcggctgagtgactacgacgttgatcatatcgtcccgcagagcttcctcaaagacgattctattgacaataaggtactgacgcgctctgataaaaaccgtggtaagtcggacaacgtgccctccgaagaggttgtgaaaaagatgaaaaattattggcgccagcttttaaacgcgaagctgatcacacaacgtaaattcgataatttgaccaaggctgaacggggtggcctgagcgagttagataaggcaggatttattaaacgccagttagtggagactcgtcaaatcaccaaacatgtcgcgcagattttggacagccggatgaacaccaagtacgatgaaaatgacaaactgatccgtgaggtgaaagtcattactctgaagtccaaattagttagtgatttccggaaggactttcaattctacaaagtccgtgaaattaataactatcatcacgcacatgacgcgtacctgaatgcagtggttgggaccgcccttatcaagaaatatcctaagctggagtcggagtttgtctatggcgactataaggtatacgatgttcgcaaaatgattgcgaaatctgagcaggagatcggtaaggcaaccgcaaaatatttcttttactcaaacattatgaatttctttaagacagaaatcactctggccaacggggagattcgcaaacgtccgttgatcgaaacaaacggcgagactggcgaaattgtttgggacaaagggcgtgatttcgcgacggtgcgcaaggtactgagcatgcctcaagtcaatattgttaagaaaaccgaagtgcagacgggcgggttttccaaggaaagcatcttacccaaacgtaattcagataaacttattgcacgcaaaaaggactgggatccgaaaaagtatggaggcttcgacagtccaaccgtagcctactctgttctcgttgtagcgaaagtagaaaagggtaaatccaagaaactgaaatctgtcaaggagttgcttggaatcaccattatggagcgtagctccttcgagaagaacccgattgactttctggaagccaaaggatataaagaggtcaagaaagatcttatcattaagctgcctaagtattcactcttcgagctggaaaatggtcgtaaacgcatgctcgcttctgccggcgagttgcagaagggcaatgaattagcacttccatcaaagtacgttaacttcctgtatttggccagccattacgagaaactgaaggggtctccagaggacaacgaacagaaacaattatttgtagagcagcacaagcattatcttgatgaaatcattgagcaaatttccgaattcagtaaacgcgtaatcctggccgatgcaaacctcgacaaggtgctgagcgcttacaataagcatcgcgacaaacctatccgtgagcaggctgaaaatatcattcacctgttcacattaacgaacctgggcgctccggccgcttttaaatatttcgacacgacaatcgaccgtaagcgctataccagtacgaaagaagtgttggatgcgacccttattcaccagtcaattacaggattatatgagacccgtatcgaccttagccaattaggtggggatgcgccagctcctgcacctgcgatggtgagcaaaggtgaagaggataatatggccatcatcaaagaattcatgcgcttcaaagttcatatggaaggtagcgttaatggccacgaatttgaaattgaaggtgaaggcgaaggtcgtccgtatgaaggcacccagaccgcaaaactgaaagttaccaaaggtggtccgctgccgtttgcatgggatattctgagtccgcagtttatgtatggtagcaaagcctatgttaaacatccggcagatatcccggattatctgaaactgagctttccggaaggttttaaatgggaacgtgtgatgaattttgaagatggtggtgttgttaccgttacacaggatagcagcctgcaggatggtgaatttatctataaagttaaactgcgtggcacgaattttccgagtgatggtccggttatgcagaaaaaaaccatgggttgggaagcaagcagcgaacgtatgtatccggaagatggcgcactgaaaggtgaaattaaacagcgtctgaagctgaaagatggcggtcattatgatgcagaagttaaaaccacctacaaagccaaaaaaccggttcagctgcctggtgcatataacgttaacattaaactggatatcaccagccacaacgaggattataccattgttgaacagtatgaacgtgcagaaggtcgccatagtaccggtggtatggatgaactgtataaa

SEQ ID NO: 377 - DNA, 4839 bp, Artificial Sequence
  SYNTHETIC
atggacaaaaagtactctattggcctggatatcgggaccaacagcgtcgggtgggctgttatcaccgacgagtataaagtaccttcgaaaaagttcaaagtgctgggcaacaccgatcgccattcaatcaaaaagaacttgattggtgcgctgttgtttgactccggggaaaccgccgaggcgactcgccttaaacgtacagcacgtcgccggtacactcggcgtaagaatcgcatttgctatttgcaggaaatctttagcaacgagatggcaaaagtcgatgactcgtttttccaccgcctcgaggaaagctttctggtggaggaagacaaaaagcatgagcgtcacccgatcttcggcaacattgtcgatgaagtagcgtatcatgaaaaatacccaaccatttaccacttacgcaaaaagctggtggacagcactgacaaagctgatttgcgccttatctatttagccctggcacatatgattaagtttcgtggtcacttcctgatcgaaggagacttaaatcccgacaacagtgatgttgataaattgtttattcagcttgtccaaacttacaatcaactgttcgaggaaaacccgatcaatgcctccggtgtggatgcaaaagccattttaagtgcacgccttagcaagtcccgtcgcttagaaaaccttatcgcgcagctgcccggcgagaaaaagaatggtttgtttgggaaccttattgccttgagcttaggcctcaccccgaatttcaaaagtaatttcgatcttgcagaagacgccaaattacaactgtcgaaggatacttatgatgacgatctcgataatctgttagcgcagattggtgaccaatacgccgatctttttctggcggctaaaaatctgagcgacgccatcttgctttcggatattctccgcgttaacaccgaaatcacgaaagcgcctcttagtgccagcatgattaaacgttatgatgaacaccaccaggacctgaccttactcaaagcgttggttcgccagcaactgccagagaagtacaaagaaatcttctttgatcagtcaaagaatggttatgccggctatattgacgggggtgcaagccaagaggaattctacaaatttatcaagcctattctggagaaaatggatggcaccgaagagttattggtgaagcttaaccgtgaagacctcctgcggaaacagcgcacattcgataatggttcgatcccacaccaaatccatttgggggagttacacgctattttgcgtcgccaggaagacttttaccctttcctgaaggataaccgggagaaaattgagaagatccttacctttcgtattccgtattacgtaggccccttagcacggggtaatagccgtttcgcgtggatgacacggaagtcggaagagacgatcaccccgtggaacttcgaagaggtagtcgacaagggcgcatcagcgcagtcttttattgaacgtatgacgaatttcgataaaaacttgcccaatgagaaggtgcttccgaaacattccttgttatatgaatattttacagtttacaacgagctgaccaaggttaaatacgtgacggaaggaatgcgcaagcccgcttttcttagcggtgagcaaaaaaaggcgatcgtcgacctgttattcaaaacgaatcgtaaggtgactgtaaagcaactcaaagaagattacttcaaaaagattgagtgcttcgacagcgtcgaaatctctggggtagaggatcggtttaacgcaagtttaggtacctaccatgacctgcttaaaatcattaaggataaagacttcttagataatgaagagaacgaagatattctcgaggacatcgtcttgacgttaaccttatttgaggatcgtgaaatgattgaggaacgcctcaaaacttatgcccacctgttcgacgataaggtgatgaagcagctgaaacgtcggcgctacacaggatggggccgcttgagtcgcaaacttattaacggaatccgtgacaagcaatccggcaaaacgattctggatttcttgaagtcggacggatttgctaatcgcaacttcatgcagttgatccatgatgactccctgacttttaaagaggatattcaaaaggcgcaggttagtggtcaaggcgacagcttacacgaacacatcgcaaatttggctggttcgccggccattaaaaaggggatcctccagaccgtgaaagttgtagatgagcttgttaaggtcatgggtcgtcataagcccgaaaacatcgtgattgaaatggcgcgggagaatcaaacgacccagaaaggacaaaagaatagccgtgaacggatgaagcggatcgaggaaggcattaaagagctggggtctcaaatcttgaaggaacaccctgtggagaacactcagctccaaaatgaaaaactttacctgtactatttgcagaacggacgcgatatgtacgtggaccaagagttggatattaatcggctgagtgactacgacgttgatcatatcgtcccgcagagcttcctcaaagacgattctattgacaataaggtactgacgcgctctgataaaaaccgtggtaagtcggacaacgtgccctccgaagaggttgtgaaaaagatgaaaaattattggcgccagcttttaaacgcgaagctgatcacacaacgtaaattcgataatttgaccaaggctgaacggggtggcctgagcgagttagataaggcaggatttattaaacgccagttagtggagactcgtcaaatcaccaaacatgtcgcgcagattttggacagccggatgaacaccaagtacgatgaaaatgacaaactgatccgtgaggtgaaagtcattactctgaagtccaaattagttagtgatttccggaaggactttcaattctacaaagtccgtgaaattaataactatcatcacgcacatgacgcgtacctgaatgcagtggttgggaccgcccttatcaagaaatatcctaagctggagtcggagtttgtctatggcgactataaggtatacgatgttcgcaaaatgattgcgaaatctgagcaggagatcggtaaggcaaccgcaaaatatttcttttactcaaacattatgaatttctttaagacagaaatcactctggccaacggggagattcgcaaacgtccgttgatcgaaacaaacggcgagactggcgaaattgtttgggacaaagggcgtgatttcgcgacggtgcgcaaggtactgagcatgcctcaagtcaatattgttaagaaaaccgaagtgcagacgggcgggttttccaaggaaagcatcttacccaaacgtaattcagataaacttattgcacgcaaaaaggactgggatccgaaaaagtatggaggcttcgacagtccaaccgtagcctactctgttctcgttgtagcgaaagtagaaaagggtaaatccaagaaactgaaatctgtcaaggagttgcttggaatcaccattatggagcgtagctccttcgagaagaacccgattgactttctggaagccaaaggatataaagaggtcaagaaagatcttatcattaagctgcctaagtattcactcttcgagctggaaaatggtcgtaaacgcatgctcgcttctgccggcgagttgcagaagggcaatgaattagcacttccatcaaagtacgttaacttcctgtatttggccagccattacgagaaactgaaggggtctccagaggacaacgaacagaaacaattatttgtagagcagcacaagcattatcttgatgaaatcattgagcaaatttccgaattcagtaaacgcgtaatcctggccgatgcaaacctcgacaaggtgctgagcgcttacaataagcatcgcgacaaacctatccgtgagcaggctgaaaatatcattcacctgttcacattaacgaacctgggcgctccggccgcttttaaatatttcgacacgacaatcgaccgtaagcgctataccagtacgaaagaagtgttggatgcgacccttattcaccagtcaattacaggattatatgagacccgtatcgaccttagccaattaggtggggatgctcctgcgccagctcctgcacctgcgatggtgagcaaaggtgaagaggataatatggccatcatcaaagaattcatgcgcttcaaagttcatatggaaggtagcgttaatggccacgaatttgaaattgaaggtgaaggcgaaggtcgtccgtatgaaggcacccagaccgcaaaactgaaagttaccaaaggtggtccgctgccgtttgcatgggatattctgagtccgcagtttatgtatggtagcaaagcctatgttaaacatccggcagatatcccggattatctgaaactgagctttccggaaggttttaaatgggaacgtgtgatgaattttgaagatggtggtgttgttaccgttacacaggatagcagcctgcaggatggtgaatttatctataaagttaaactgcgtggcacgaattttccgagtgatggtccggttatgcagaaaaaaaccatgggttgggaagcaagcagcgaacgtatgtatccggaagatggcgcactgaaaggtgaaattaaacagcgtctgaagctgaaagatggcggtcattatgatgcagaagttaaaaccacctacaaagccaaaaaaccggttcagctgcctggtgcatataacgttaacattaaactggatatcaccagccacaacgaggattataccattgttgaacagtatgaacgtgcagaaggtcgccatagtaccggtggtatggatgaactgtataaa

SEQ ID NO: 378 - DNA, 4845 bp, Artificial Sequence
  SYNTHETIC
atggacaaaaagtactctattggcctggatatcgggaccaacagcgtcgggtgggctgttatcaccgacgagtataaagtaccttcgaaaaagttcaaagtgctgggcaacaccgatcgccattcaatcaaaaagaacttgattggtgcgctgttgtttgactccggggaaaccgccgaggcgactcgccttaaacgtacagcacgtcgccggtacactcggcgtaagaatcgcatttgctatttgcaggaaatctttagcaacgagatggcaaaagtcgatgactcgtttttccaccgcctcgaggaaagctttctggtggaggaagacaaaaagcatgagcgtcacccgatcttcggcaacattgtcgatgaagtagcgtatcatgaaaaatacccaaccatttaccacttacgcaaaaagctggtggacagcactgacaaagctgatttgcgccttatctatttagccctggcacatatgattaagtttcgtggtcacttcctgatcgaaggagacttaaatcccgacaacagtgatgttgataaattgtttattcagcttgtccaaacttacaatcaactgttcgaggaaaacccgatcaatgcctccggtgtggatgcaaaagccattttaagtgcacgccttagcaagtcccgtcgcttagaaaaccttatcgcgcagctgcccggcgagaaaaagaatggtttgtttgggaaccttattgccttgagcttaggcctcaccccgaatttcaaaagtaatttcgatcttgcagaagacgccaaattacaactgtcgaaggatacttatgatgacgatctcgataatctgttagcgcagattggtgaccaatacgccgatctttttctggcggctaaaaatctgagcgacgccatcttgctttcggatattctccgcgttaacaccgaaatcacgaaagcgcctcttagtgccagcatgattaaacgttatgatgaacaccaccaggacctgaccttactcaaagcgttggttcgccagcaactgccagagaagtacaaagaaatcttctttgatcagtcaaagaatggttatgccggctatattgacgggggtgcaagccaagaggaattctacaaatttatcaagcctattctggagaaaatggatggcaccgaagagttattggtgaagcttaaccgtgaagacctcctgcggaaacagcgcacattcgataatggttcgatcccacaccaaatccatttgggggagttacacgctattttgcgtcgccaggaagacttttaccctttcctgaaggataaccgggagaaaattgagaagatccttacctttcgtattccgtattacgtaggccccttagcacggggtaatagccgtttcgcgtggatgacacggaagtcggaagagacgatcaccccgtggaacttcgaagaggtagtcgacaagggcgcatcagcgcagtcttttattgaacgtatgacgaatttcgataaaaacttgcccaatgagaaggtgcttccgaaacattccttgttatatgaatattttacagtttacaacgagctgaccaaggttaaatacgtgacggaaggaatgcgcaagcccgcttttcttagcggtgagcaaaaaaaggcgatcgtcgacctgttattcaaaacgaatcgtaaggtgactgtaaagcaactcaaagaagattacttcaaaaagattgagtgcttcgacagcgtcgaaatctctggggtagaggatcggtttaacgcaagtttaggtacctaccatgacctgcttaaaatcattaaggataaagacttcttagataatgaagagaacgaagatattctcgaggacatcgtcttgacgttaaccttatttgaggatcgtgaaatgattgaggaacgcctcaaaacttatgcccacctgttcgacgataaggtgatgaagcagctgaaacgtcggcgctacacaggatggggccgcttgagtcgcaaacttattaacggaatccgtgacaagcaatccggcaaaacgattctggatttcttgaagtcggacggatttgctaatcgcaacttcatgcagttgatccatgatgactccctgacttttaaagaggatattcaaaaggcgcaggttagtggtcaaggcgacagcttacacgaacacatcgcaaatttggctggttcgccggccattaaaaaggggatcctccagaccgtgaaagttgtagatgagcttgttaaggtcatgggtcgtcataagcccgaaaacatcgtgattgaaatggcgcgggagaatcaaacgacccagaaaggacaaaagaatagccgtgaacggatgaagcggatcgaggaaggcattaaagagctggggtctcaaatcttgaaggaacaccctgtggagaacactcagctccaaaatgaaaaactttacctgtactatttgcagaacggacgcgatatgtacgtggaccaagagttggatattaatcggctgagtgactacgacgttgatcatatcgtcccgcagagcttcctcaaagacgattctattgacaataaggtactgacgcgctctgataaaaaccgtggtaagtcggacaacgtgccctccgaagaggttgtgaaaaagatgaaaaattattggcgccagcttttaaacgcgaagctgatcacacaacgtaaattcgataatttgaccaaggctgaacggggtggcctgagcgagttagataaggcaggatttattaaacgccagttagtggagactcgtcaaatcaccaaacatgtcgcgcagattttggacagccggatgaacaccaagtacgatgaaaatgacaaactgatccgtgaggtgaaagtcattactctgaagtccaaattagttagtgatttccggaaggactttcaattctacaaagtccgtgaaattaataactatcatcacgcacatgacgcgtacctgaatgcagtggttgggaccgcccttatcaagaaatatcctaagctggagtcggagtttgtctatggcgactataaggtatacgatgttcgcaaaatgattgcgaaatctgagcaggagatcggtaaggcaaccgcaaaatatttcttttactcaaacattatgaatttctttaagacagaaatcactctggccaacggggagattcgcaaacgtccgttgatcgaaacaaacggcgagactggcgaaattgtttgggacaaagggcgtgatttcgcgacggtgcgcaaggtactgagcatgcctcaagtcaatattgttaagaaaaccgaagtgcagacgggcgggttttccaaggaaagcatcttacccaaacgtaattcagataaacttattgcacgcaaaaaggactgggatccgaaaaagtatggaggcttcgacagtccaaccgtagcctactctgttctcgttgtagcgaaagtagaaaagggtaaatccaagaaactgaaatctgtcaaggagttgcttggaatcaccattatggagcgtagctccttcgagaagaacccgattgactttctggaagccaaaggatataaagaggtcaagaaagatcttatcattaagctgcctaagtattcactcttcgagctggaaaatggtcgtaaacgcatgctcgcttctgccggcgagttgcagaagggcaatgaattagcacttccatcaaagtacgttaacttcctgtatttggccagccattacgagaaactgaaggggtctccagaggacaacgaacagaaacaattatttgtagagcagcacaagcattatcttgatgaaatcattgagcaaatttccgaattcagtaaacgcgtaatcctggccgatgcaaacctcgacaaggtgctgagcgcttacaataagcatcgcgacaaacctatccgtgagcaggctgaaaatatcattcacctgttcacattaacgaacctgggcgctccggccgcttttaaatatttcgacacgacaatcgaccgtaagcgctataccagtacgaaagaagtgttggatgcgacccttattcaccagtcaattacaggattatatgagacccgtatcgaccttagccaattaggtggggatgcgcccgctcctgcgccagctcctgcacctgcgatggtgagcaaaggtgaagaggataatatggccatcatcaaagaattcatgcgcttcaaagttcatatggaaggtagcgttaatggccacgaatttgaaattgaaggtgaaggcgaaggtcgtccgtatgaaggcacccagaccgcaaaactgaaagttaccaaaggtggtccgctgccgtttgcatgggatattctgagtccgcagtttatgtatggtagcaaagcctatgttaaacatccggcagatatcccggattatctgaaactgagctttccggaaggttttaaatgggaacgtgtgatgaattttgaagatggtggtgttgttaccgttacacaggatagcagcctgcaggatggtgaatttatctataaagttaaactgcgtggcacgaattttccgagtgatggtccggttatgcagaaaaaaaccatgggttgggaagcaagcagcgaacgtatgtatccggaagatggcgcactgaaaggtgaaattaaacagcgtctgaagctgaaagatggcggtcattatgatgcagaagttaaaaccacctacaaagccaaaaaaccggttcagctgcctggtgcatataacgttaacattaaactggatatcaccagccacaacgaggattataccattgttgaacagtatgaacgtgcagaaggtcgccatagtaccggtggtatggatgaactgtataaa

SEQ ID NO: 379 - DNA, 4851 bp, Artificial Sequence
  SYNTHETIC
atggacaaaaagtactctattggcctggatatcgggaccaacagcgtcgggtgggctgttatcaccgacgagtataaagtaccttcgaaaaagttcaaagtgctgggcaacaccgatcgccattcaatcaaaaagaacttgattggtgcgctgttgtttgactccggggaaaccgccgaggcgactcgccttaaacgtacagcacgtcgccggtacactcggcgtaagaatcgcatttgctatttgcaggaaatctttagcaacgagatggcaaaagtcgatgactcgtttttccaccgcctcgaggaaagctttctggtggaggaagacaaaaagcatgagcgtcacccgatcttcggcaacattgtcgatgaagtagcgtatcatgaaaaatacccaaccatttaccacttacgcaaaaagctggtggacagcactgacaaagctgatttgcgccttatctatttagccctggcacatatgattaagtttcgtggtcacttcctgatcgaaggagacttaaatcccgacaacagtgatgttgataaattgtttattcagcttgtccaaacttacaatcaactgttcgaggaaaacccgatcaatgcctccggtgtggatgcaaaagccattttaagtgcacgccttagcaagtcccgtcgcttagaaaaccttatcgcgcagctgcccggcgagaaaaagaatggtttgtttgggaaccttattgccttgagcttaggcctcaccccgaatttcaaaagtaatttcgatcttgcagaagacgccaaattacaactgtcgaaggatacttatgatgacgatctcgataatctgttagcgcagattggtgaccaatacgccgatctttttctggcggctaaaaatctgagcgacgccatcttgctttcggatattctccgcgttaacaccgaaatcacgaaagcgcctcttagtgccagcatgattaaacgttatgatgaacaccaccaggacctgaccttactcaaagcgttggttcgccagcaactgccagagaagtacaaagaaatcttctttgatcagtcaaagaatggttatgccggctatattgacgggggtgcaagccaagaggaattctacaaatttatcaagcctattctggagaaaatggatggcaccgaagagttattggtgaagcttaaccgtgaagacctcctgcggaaacagcgcacattcgataatggttcgatcccacaccaaatccatttgggggagttacacgctattttgcgtcgccaggaagacttttaccctttcctgaaggataaccgggagaaaattgagaagatccttacctttcgtattccgtattacgtaggccccttagcacggggtaatagccgtttcgcgtggatgacacggaagtcggaagagacgatcaccccgtggaacttcgaagaggtagtcgacaagggcgcatcagcgcagtcttttattgaacgtatgacgaatttcgataaaaacttgcccaatgagaaggtgcttccgaaacattccttgttatatgaatattttacagtttacaacgagctgaccaaggttaaatacgtgacggaaggaatgcgcaagcccgcttttcttagcggtgagcaaaaaaaggcgatcgtcgacctgttattcaaaacgaatcgtaaggtgactgtaaagcaactcaaagaagattacttcaaaaagattgagtgcttcgacagcgtcgaaatctctggggtagaggatcggtttaacgcaagtttaggtacctaccatgacctgcttaaaatcattaaggataaagacttcttagataatgaagagaacgaagatattctcgaggacatcgtcttgacgttaaccttatttgaggatcgtgaaatgattgaggaacgcctcaaaacttatgcccacctgttcgacgataaggtgatgaagcagctgaaacgtcggcgctacacaggatggggccgcttgagtcgcaaacttattaacggaatccgtgacaagcaatccggcaaaacgattctggatttcttgaagtcggacggatttgctaatcgcaacttcatgcagttgatccatgatgactccctgacttttaaagaggatattcaaaaggcgcaggttagtggtcaaggcgacagcttacacgaacacatcgcaaatttggctggttcgccggccattaaaaaggggatcctccagaccgtgaaagttgtagatgagcttgttaaggtcatgggtcgtcataagcccgaaaacatcgtgattgaaatggcgcgggagaatcaaacgacccagaaaggacaaaagaatagccgtgaacggatgaagcggatcgaggaaggcattaaagagctggggtctcaaatcttgaaggaacaccctgtggagaacactcagctccaaaatgaaaaactttacctgtactatttgcagaacggacgcgatatgtacgtggaccaagagttggatattaatcggctgagtgactacgacgttgatcatatcgtcccgcagagcttcctcaaagacgattctattgacaataaggtactgacgcgctctgataaaaaccgtggtaagtcggacaacgtgccctccgaagaggttgtgaaaaagatgaaaaattattggcgccagcttttaaacgcgaagctgatcacacaacgtaaattcgataatttgaccaaggctgaacggggtggcctgagcgagttagataaggcaggatttattaaacgccagttagtggagactcgtcaaatcaccaaacatgtcgcgcagattttggacagccggatgaacaccaagtacgatgaaaatgacaaactgatccgtgaggtgaaagtcattactctgaagtccaaattagttagtgatttccggaaggactttcaattctacaaagtccgtgaaattaataactatcatcacgcacatgacgcgtacctgaatgcagtggttgggaccgcccttatcaagaaatatcctaagctggagtcggagtttgtctatggcgactataaggtatacgatgttcgcaaaatgattgcgaaatctgagcaggagatcggtaaggcaaccgcaaaatatttcttttactcaaacattatgaatttctttaagacagaaatcactctggccaacggggagattcgcaaacgtccgttgatcgaaacaaacggcgagactggcgaaattgtttgggacaaagggcgtgatttcgcgacggtgcgcaaggtactgagcatgcctcaagtcaatattgttaagaaaaccgaagtgcagacgggcgggttttccaaggaaagcatcttacccaaacgtaattcagataaacttattgcacgcaaaaaggactgggatccgaaaaagtatggaggcttcgacagtccaaccgtagcctactctgttctcgttgtagcgaaagtagaaaagggtaaatccaagaaactgaaatctgtcaaggagttgcttggaatcaccattatggagcgtagctccttcgagaagaacccgattgactttctggaagccaaaggatataaagaggtcaagaaagatcttatcattaagctgcctaagtattcactcttcgagctggaaaatggtcgtaaacgcatgctcgcttctgccggcgagttgcagaagggcaatgaattagcacttccatcaaagtacgttaacttcctgtatttggccagccattacgagaaactgaaggggtctccagaggacaacgaacagaaacaattatttgtagagcagcacaagcattatcttgatgaaatcattgagcaaatttccgaattcagtaaacgcgtaatcctggccgatgcaaacctcgacaaggtgctgagcgcttacaataagcatcgcgacaaacctatccgtgagcaggctgaaaatatcattcacctgttcacattaacgaacctgggcgctccggccgcttttaaatatttcgacacgacaatcgaccgtaagcgctataccagtacgaaagaagtgttggatgcgacccttattcaccagtcaattacaggattatatgagacccgtatcgaccttagccaattaggtggggatgcgccagcgcctgctcctgcacccgctccagcacctgcgatggtgagcaaaggtgaagaggataatatggccatcatcaaagaattcatgcgcttcaaagttcatatggaaggtagcgttaatggccacgaatttgaaattgaaggtgaaggcgaaggtcgtccgtatgaaggcacccagaccgcaaaactgaaagttaccaaaggtggtccgctgccgtttgcatgggatattctgagtccgcagtttatgtatggtagcaaagcctatgttaaacatccggcagatatcccggattatctgaaactgagctttccggaaggttttaaatgggaacgtgtgatgaattttgaagatggtggtgttgttaccgttacacaggatagcagcctgcaggatggtgaatttatctataaagttaaactgcgtggcacgaattttccgagtgatggtccggttatgcagaaaaaaaccatgggttgggaagcaagcagcgaacgtatgtatccggaagatggcgcactgaaaggtgaaattaaacagcgtctgaagctgaaagatggcggtcattatgatgcagaagttaaaaccacctacaaagccaaaaaaccggttcagctgcctggtgcatataacgttaacattaaactggatatcaccagccacaacgaggattataccattgttgaacagtatgaacgtgcagaaggtcgccatagtaccggtggtatggatgaactgtataaa

SEQ ID NO: 380 - DNA, 4857 bp, Artificial Sequence
  SYNTHETIC
atggacaaaaagtactctattggcctggatatcgggaccaacagcgtcgggtgggctgttatcaccgacgagtataaagtaccttcgaaaaagttcaaagtgctgggcaacaccgatcgccattcaatcaaaaagaacttgattggtgcgctgttgtttgactccggggaaaccgccgaggcgactcgccttaaacgtacagcacgtcgccggtacactcggcgtaagaatcgcatttgctatttgcaggaaatctttagcaacgagatggcaaaagtcgatgactcgtttttccaccgcctcgaggaaagctttctggtggaggaagacaaaaagcatgagcgtcacccgatcttcggcaacattgtcgatgaagtagcgtatcatgaaaaatacccaaccatttaccacttacgcaaaaagctggtggacagcactgacaaagctgatttgcgccttatctatttagccctggcacatatgattaagtttcgtggtcacttcctgatcgaaggagacttaaatcccgacaacagtgatgttgataaattgtttattcagcttgtccaaacttacaatcaactgttcgaggaaaacccgatcaatgcctccggtgtggatgcaaaagccattttaagtgcacgccttagcaagtcccgtcgcttagaaaaccttatcgcgcagctgcccggcgagaaaaagaatggtttgtttgggaaccttattgccttgagcttaggcctcaccccgaatttcaaaagtaatttcgatcttgcagaagacgccaaattacaactgtcgaaggatacttatgatgacgatctcgataatctgttagcgcagattggtgaccaatacgccgatctttttctggcggctaaaaatctgagcgacgccatcttgctttcggatattctccgcgttaacaccgaaatcacgaaagcgcctcttagtgccagcatgattaaacgttatgatgaacaccaccaggacctgaccttactcaaagcgttggttcgccagcaactgccagagaagtacaaagaaatcttctttgatcagtcaaagaatggttatgccggctatattgacgggggtgcaagccaagaggaattctacaaatttatcaagcctattctggagaaaatggatggcaccgaagagttattggtgaagcttaaccgtgaagacctcctgcggaaacagcgcacattcgataatggttcgatcccacaccaaatccatttgggggagttacacgctattttgcgtcgccaggaagacttttaccctttcctgaaggataaccgggagaaaattgagaagatccttacctttcgtattccgtattacgtaggccccttagcacggggtaatagccgtttcgcgtggatgacacggaagtcggaagagacgatcaccccgtggaacttcgaagaggtagtcgacaagggcgcatcagcgcagtcttttattgaacgtatgacgaatttcgataaaaacttgcccaatgagaaggtgcttccgaaacattccttgttatatgaatattttacagtttacaacgagctgaccaaggttaaatacgtgacggaaggaatgcgcaagcccgcttttcttagcggtgagcaaaaaaaggcgatcgtcgacctgttattcaaaacgaatcgtaaggtgactgtaaagcaactcaaagaagattacttcaaaaagattgagtgcttcgacagcgtcgaaatctctggggtagaggatcggtttaacgcaagtttaggtacctaccatgacctgcttaaaatcattaaggataaagacttcttagataatgaagagaacgaagatattctcgaggacatcgtcttgacgttaaccttatttgaggatcgtgaaatgattgaggaacgcctcaaaacttatgcccacctgttcgacgataaggtgatgaagcagctgaaacgtcggcgctacacaggatggggccgcttgagtcgcaaacttattaacggaatccgtgacaagcaatccggcaaaacgattctggatttcttgaagtcggacggatttgctaatcgcaacttcatgcagttgatccatgatgactccctgacttttaaagaggatattcaaaaggcgcaggttagtggtcaaggcgacagcttacacgaacacatcgcaaatttggctggttcgccggccattaaaaaggggatcctccagaccgtgaaagttgtagatgagcttgttaaggtcatgggtcgtcataagcccgaaaacatcgtgattgaaatggcgcgggagaatcaaacgacccagaaaggacaaaagaatagccgtgaacggatgaagcggatcgaggaaggcattaaagagctggggtctcaaatcttgaaggaacaccctgtggagaacactcagctccaaaatgaaaaactttacctgtactatttgcagaacggacgcgatatgtacgtggaccaagagttggatattaatcggctgagtgactacgacgttgatcatatcgtcccgcagagcttcctcaaagacgattctattgacaataaggtactgacgcgctctgataaaaaccgtggtaagtcggacaacgtgccctccgaagaggttgtgaaaaagatgaaaaattattggcgccagcttttaaacgcgaagctgatcacacaacgtaaattcgataatttgaccaaggctgaacggggtggcctgagcgagttagataaggcaggatttattaaacgccagttagtggagactcgtcaaatcaccaaacatgtcgcgcagattttggacagccggatgaacaccaagtacgatgaaaatgacaaactgatccgtgaggtgaaagtcattactctgaagtccaaattagttagtgatttccggaaggactttcaattctacaaagtccgtgaaattaataactatcatcacgcacatgacgcgtacctgaatgcagtggttgggaccgcccttatcaagaaatatcctaagctggagtcggagtttgtctatggcgactataaggtatacgatgttcgcaaaatgattgcgaaatctgagcaggagatcggtaaggcaaccgcaaaatatttcttttactcaaacattatgaatttctttaagacagaaatcactctggccaacggggagattcgcaaacgtccgttgatcgaaacaaacggcgagactggcgaaattgtttgggacaaagggcgtgatttcgcgacggtgcgcaaggtactgagcatgcctcaagtcaatattgttaagaaaaccgaagtgcagacgggcgggttttccaaggaaagcatcttacccaaacgtaattcagataaacttattgcacgcaaaaaggactgggatccgaaaaagtatggaggcttcgacagtccaaccgtagcctactctgttctcgttgtagcgaaagtagaaaagggtaaatccaagaaactgaaatctgtcaaggagttgcttggaatcaccattatggagcgtagctccttcgagaagaacccgattgactttctggaagccaaaggatataaagaggtcaagaaagatcttatcattaagctgcctaagtattcactcttcgagctggaaaatggtcgtaaacgcatgctcgcttctgccggcgagttgcagaagggcaatgaattagcacttccatcaaagtacgttaacttcctgtatttggccagccattacgagaaactgaaggggtctccagaggacaacgaacagaaacaattatttgtagagcagcacaagcattatcttgatgaaatcattgagcaaatttccgaattcagtaaacgcgtaatcctggccgatgcaaacctcgacaaggtgctgagcgcttacaataagcatcgcgacaaacctatccgtgagcaggctgaaaatatcattcacctgttcacattaacgaacctgggcgctccggccgcttttaaatatttcgacacgacaatcgaccgtaagcgctataccagtacgaaagaagtgttggatgcgacccttattcaccagtcaattacaggattatatgagacccgtatcgaccttagccaattaggtggggatgcgccagcgcctgctcctgcacccgctccagctcctgccccagcgatggtgagcaaaggtgaagaggataatatggccatcatcaaagaattcatgcgcttcaaagttcatatggaaggtagcgttaatggccacgaatttgaaattgaaggtgaaggcgaaggtcgtccgtatgaaggcacccagaccgcaaaactgaaagttaccaaaggtggtccgctgccgtttgcatgggatattctgagtccgcagtttatgtatggtagcaaagcctatgttaaacatccggcagatatcccggattatctgaaactgagctttccggaaggttttaaatgggaacgtgtgatgaattttgaagatggtggtgttgttaccgttacacaggatagcagcctgcaggatggtgaatttatctataaagttaaactgcgtggcacgaattttccgagtgatggtccggttatgcagaaaaaaaccatgggttgggaagcaagcagcgaacgtatgtatccggaagatggcgcactgaaaggtgaaattaaacagcgtctgaagctgaaagatggcggtcattatgatgcagaagttaaaaccacctacaaagccaaaaaaccggttcagctgcctggtgcatataacgttaacattaaactggatatcaccagccacaacgaggattataccattgttgaacagtatgaacgtgcagaaggtcgccatagtaccggtggtatggatgaactgtataaa

SEQ ID NO: 381 - DNA, 4863 bp, Artificial Sequence
  SYNTHETIC
atggacaaaaagtactctattggcctggatatcgggaccaacagcgtcgggtgggctgttatcaccgacgagtataaagtaccttcgaaaaagttcaaagtgctgggcaacaccgatcgccattcaatcaaaaagaacttgattggtgcgctgttgtttgactccggggaaaccgccgaggcgactcgccttaaacgtacagcacgtcgccggtacactcggcgtaagaatcgcatttgctatttgcaggaaatctttagcaacgagatggcaaaagtcgatgactcgtttttccaccgcctcgaggaaagctttctggtggaggaagacaaaaagcatgagcgtcacccgatcttcggcaacattgtcgatgaagtagcgtatcatgaaaaatacccaaccatttaccacttacgcaaaaagctggtggacagcactgacaaagctgatttgcgccttatctatttagccctggcacatatgattaagtttcgtggtcacttcctgatcgaaggagacttaaatcccgacaacagtgatgttgataaattgtttattcagcttgtccaaacttacaatcaactgttcgaggaaaacccgatcaatgcctccggtgtggatgcaaaagccattttaagtgcacgccttagcaagtcccgtcgcttagaaaaccttatcgcgcagctgcccggcgagaaaaagaatggtttgtttgggaaccttattgccttgagcttaggcctcaccccgaatttcaaaagtaatttcgatcttgcagaagacgccaaattacaactgtcgaaggatacttatgatgacgatctcgataatctgttagcgcagattggtgaccaatacgccgatctttttctggcggctaaaaatctgagcgacgccatcttgctttcggatattctccgcgttaacaccgaaatcacgaaagcgcctcttagtgccagcatgattaaacgttatgatgaacaccaccaggacctgaccttactcaaagcgttggttcgccagcaactgccagagaagtacaaagaaatcttctttgatcagtcaaagaatggttatgccggctatattgacgggggtgcaagccaagaggaattctacaaatttatcaagcctattctggagaaaatggatggcaccgaagagttattggtgaagcttaaccgtgaagacctcctgcggaaacagcgcacattcgataatggttcgatcccacaccaaatccatttgggggagttacacgctattttgcgtcgccaggaagacttttaccctttcctgaaggataaccgggagaaaattgagaagatccttacctttcgtattccgtattacgtaggccccttagcacggggtaatagccgtttcgcgtggatgacacggaagtcggaagagacgatcaccccgtggaacttcgaagaggtagtcgacaagggcgcatcagcgcagtcttttattgaacgtatgacgaatttcgataaaaacttgcccaatgagaaggtgcttccgaaacattccttgttatatgaatattttacagtttacaacgagctgaccaaggttaaatacgtgacggaaggaatgcgcaagcccgcttttcttagcggtgagcaaaaaaaggcgatcgtcgacctgttattcaaaacgaatcgtaaggtgactgtaaagcaactcaaagaagattacttcaaaaagattgagtgcttcgacagcgtcgaaatctctggggtagaggatcggtttaacgcaagtttaggtacctaccatgacctgcttaaaatcattaaggataaagacttcttagataatgaagagaacgaagatattctcgaggacatcgtcttgacgttaaccttatttgaggatcgtgaaatgattgaggaacgcctcaaaacttatgcccacctgttcgacgataaggtgatgaagcagctgaaacgtcggcgctacacaggatggggccgcttgagtcgcaaacttattaacggaatccgtgacaagcaatccggcaaaacgattctggatttcttgaagtcggacggatttgctaatcgcaacttcatgcagttgatccatgatgactccctgacttttaaagaggatattcaaaaggcgcaggttagtggtcaaggcgacagcttacacgaacacatcgcaaatttggctggttcgccggccattaaaaaggggatcctccagaccgtgaaagttgtagatgagcttgttaaggtcatgggtcgtcataagcccgaaaacatcgtgattgaaatggcgcgggagaatcaaacgacccagaaaggacaaaagaatagccgtgaacggatgaagcggatcgaggaaggcattaaagagctggggtctcaaatcttgaaggaacaccctgtggagaacactcagctccaaaatgaaaaactttacctgtactatttgcagaacggacgcgatatgtacgtggaccaagagttggatattaatcggctgagtgactacgacgttgatcatatcgtcccgcagagcttcctcaaagacgattctattgacaataaggtactgacgcgctctgataaaaaccgtggtaagtcggacaacgtgccctccgaagaggttgtgaaaaagatgaaaaattattggcgccagcttttaaacgcgaagctgatcacacaacgtaaattcgataatttgaccaaggctgaacggggtggcctgagcgagttagataaggcaggatttattaaacgccagttagtggagactcgtcaaatcaccaaacatgtcgcgcagattttggacagccggatgaacaccaagtacgatgaaaatgacaaactgatccgtgaggtgaaagtcattactctgaagtccaaattagttagtgatttccggaaggactttcaattctacaaagtccgtgaaattaataactatcatcacgcacatgacgcgtacctgaatgcagtggttgggaccgcccttatcaagaaatatcctaagctggagtcggagtttgtctatggcgactataaggtatacgatgttcgcaaaatgattgcgaaatctgagcaggagatcggtaaggcaaccgcaaaatatttcttttactcaaacattatgaatttctttaagacagaaatcactctggccaacggggagattcgcaaacgtccgttgatcgaaacaaacggcgagactggcgaaattgtttgggacaaagggcgtgatttcgcgacggtgcgcaaggtactgagcatgcctcaagtcaatattgttaagaaaaccgaagtgcagacgggcgggttttccaaggaaagcatcttacccaaacgtaattcagataaacttattgcacgcaaaaaggactgggatccgaaaaagtatggaggcttcgacagtccaaccgtagcctactctgttctcgttgtagcgaaagtagaaaagggtaaatccaagaaactgaaatctgtcaaggagttgcttggaatcaccattatggagcgtagctccttcgagaagaacccgattgactttctggaagccaaaggatataaagaggtcaagaaagatcttatcattaagctgcctaagtattcactcttcgagctggaaaatggtcgtaaacgcatgctcgcttctgccggcgagttgcagaagggcaatgaattagcacttccatcaaagtacgttaacttcctgtatttggccagccattacgagaaactgaaggggtctccagaggacaacgaacagaaacaattatttgtagagcagcacaagcattatcttgatgaaatcattgagcaaatttccgaattcagtaaacgcgtaatcctggccgatgcaaacctcgacaaggtgctgagcgcttacaataagcatcgcgacaaacctatccgtgagcaggctgaaaatatcattcacctgttcacattaacgaacctgggcgctccggccgcttttaaatatttcgacacgacaatcgaccgtaagcgctataccagtacgaaagaagtgttggatgcgacccttattcaccagtcaattacaggattatatgagacccgtatcgaccttagccaattaggtggggatgcgccagcgcctgctcctgcacccgctccagcgccagctcctgcacctgcgatggtgagcaaaggtgaagaggataatatggccatcatcaaagaattcatgcgcttcaaagttcatatggaaggtagcgttaatggccacgaatttgaaattgaaggtgaaggcgaaggtcgtccgtatgaaggcacccagaccgcaaaactgaaagttaccaaaggtggtccgctgccgtttgcatgggatattctgagtccgcagtttatgtatggtagcaaagcctatgttaaacatccggcagatatcccggattatctgaaactgagctttccggaaggttttaaatgggaacgtgtgatgaattttgaagatggtggtgttgttaccgttacacaggatagcagcctgcaggatggtgaatttatctataaagttaaactgcgtggcacgaattttccgagtgatggtccggttatgcagaaaaaaaccatgggttgggaagcaagcagcgaacgtatgtatccggaagatggcgcactgaaaggtgaaattaaacagcgtctgaagctgaaagatggcggtcattatgatgcagaagttaaaaccacctacaaagccaaaaaaccggttcagctgcctggtgcatataacgttaacattaaactggatatcaccagccacaacgaggattataccattgttgaacagtatgaacgtgcagaaggtcgccatagtaccggtggtatggatgaactgtataaa

SEQ ID NO: 382 - DNA, 4869 bp, Artificial Sequence
  SYNTHETIC
atggacaaaaagtactctattggcctggatatcgggaccaacagcgtcgggtgggctgttatcaccgacgagtataaagtaccttcgaaaaagttcaaagtgctgggcaacaccgatcgccattcaatcaaaaagaacttgattggtgcgctgttgtttgactccggggaaaccgccgaggcgactcgccttaaacgtacagcacgtcgccggtacactcggcgtaagaatcgcatttgctatttgcaggaaatctttagcaacgagatggcaaaagtcgatgactcgtttttccaccgcctcgaggaaagctttctggtggaggaagacaaaaagcatgagcgtcacccgatcttcggcaacattgtcgatgaagtagcgtatcatgaaaaatacccaaccatttaccacttacgcaaaaagctggtggacagcactgacaaagctgatttgcgccttatctatttagccctggcacatatgattaagtttcgtggtcacttcctgatcgaaggagacttaaatcccgacaacagtgatgttgataaattgtttattcagcttgtccaaacttacaatcaactgttcgaggaaaacccgatcaatgcctccggtgtggatgcaaaagccattttaagtgcacgccttagcaagtcccgtcgcttagaaaaccttatcgcgcagctgcccggcgagaaaaagaatggtttgtttgggaaccttattgccttgagcttaggcctcaccccgaatttcaaaagtaatttcgatcttgcagaagacgccaaattacaactgtcgaaggatacttatgatgacgatctcgataatctgttagcgcagattggtgaccaatacgccgatctttttctggcggctaaaaatctgagcgacgccatcttgctttcggatattctccgcgttaacaccgaaatcacgaaagcgcctcttagtgccagcatgattaaacgttatgatgaacaccaccaggacctgaccttactcaaagcgttggttcgccagcaactgccagagaagtacaaagaaatcttctttgatcagtcaaagaatggttatgccggctatattgacgggggtgcaagccaagaggaattctacaaatttatcaagcctattctggagaaaatggatggcaccgaagagttattggtgaagcttaaccgtgaagacctcctgcggaaacagcgcacattcgataatggttcgatcccacaccaaatccatttgggggagttacacgctattttgcgtcgccaggaagacttttaccctttcctgaaggataaccgggagaaaattgagaagatccttacctttcgtattccgtattacgtaggccccttagcacggggtaatagccgtttcgcgtggatgacacggaagtcggaagagacgatcaccccgtggaacttcgaagaggtagtcgacaagggcgcatcagcgcagtcttttattgaacgtatgacgaatttcgataaaaacttgcccaatgagaaggtgcttccgaaacattccttgttatatgaatattttacagtttacaacgagctgaccaaggttaaatacgtgacggaaggaatgcgcaagcccgcttttcttagcggtgagcaaaaaaaggcgatcgtcgacctgttattcaaaacgaatcgtaaggtgactgtaaagcaactcaaagaagattacttcaaaaagattgagtgcttcgacagcgtcgaaatctctggggtagaggatcggtttaacgcaagtttaggtacctaccatgacctgcttaaaatcattaaggataaagacttcttagataatgaagagaacgaagatattctcgaggacatcgtcttgacgttaaccttatttgaggatcgtgaaatgattgaggaacgcctcaaaacttatgcccacctgttcgacgataaggtgatgaagcagctgaaacgtcggcgctacacaggatggggccgcttgagtcgcaaacttattaacggaatccgtgacaagcaatccggcaaaacgattctggatttcttgaagtcggacggatttgctaatcgcaacttcatgcagttgatccatgatgactccctgacttttaaagaggatattcaaaaggcgcaggttagtggtcaaggcgacagcttacacgaacacatcgcaaatttggctggttcgccggccattaaaaaggggatcctccagaccgtgaaagttgtagatgagcttgttaaggtcatgggtcgtcataagcccgaaaacatcgtgattgaaatggcgcgggagaatcaaacgacccagaaaggacaaaagaatagccgtgaacggatgaagcggatcgaggaaggcattaaagagctggggtctcaaatcttgaaggaacaccctgtggagaacactcagctccaaaatgaaaaactttacctgtactatttgcagaacggacgcgatatgtacgtggaccaagagttggatattaatcggctgagtgactacgacgttgatcatatcgtcccgcagagcttcctcaaagacgattctattgacaataaggtactgacgcgctctgataaaaaccgtggtaagtcggacaacgtgccctccgaagaggttgtgaaaaagatgaaaaattattggcgccagcttttaaacgcgaagctgatcacacaacgtaaattcgataatttgaccaaggctgaacggggtggcctgagcgagttagataaggcaggatttattaaacgccagttagtggagactcgtcaaatcaccaaacatgtcgcgcagattttggacagccggatgaacaccaagtacgatgaaaatgacaaactgatccgtgaggtgaaagtcattactctgaagtccaaattagttagtgatttccggaaggactttcaattctacaaagtccgtgaaattaataactatcatcacgcacatgacgcgtacctgaatgcagtggttgggaccgcccttatcaagaaatatcctaagctggagtcggagtttgtctatggcgactataaggtatacgatgttcgcaaaatgattgcgaaatctgagcaggagatcggtaaggcaaccgcaaaatatttcttttactcaaacattatgaatttctttaagacagaaatcactctggccaacggggagattcgcaaacgtccgttgatcgaaacaaacggcgagactggcgaaattgtttgggacaaagggcgtgatttcgcgacggtgcgcaaggtactgagcatgcctcaagtcaatattgttaagaaaaccgaagtgcagacgggcgggttttccaaggaaagcatcttacccaaacgtaattcagataaacttattgcacgcaaaaaggactgggatccgaaaaagtatggaggcttcgacagtccaaccgtagcctactctgttctcgttgtagcgaaagtagaaaagggtaaatccaagaaactgaaatctgtcaaggagttgcttggaatcaccattatggagcgtagctccttcgagaagaacccgattgactttctggaagccaaaggatataaagaggtcaagaaagatcttatcattaagctgcctaagtattcactcttcgagctggaaaatggtcgtaaacgcatgctcgcttctgccggcgagttgcagaagggcaatgaattagcacttccatcaaagtacgttaacttcctgtatttggccagccattacgagaaactgaaggggtctccagaggacaacgaacagaaacaattatttgtagagcagcacaagcattatcttgatgaaatcattgagcaaatttccgaattcagtaaacgcgtaatcctggccgatgcaaacctcgacaaggtgctgagcgcttacaataagcatcgcgacaaacctatccgtgagcaggctgaaaatatcattcacctgttcacattaacgaacctgggcgctccggccgcttttaaatatttcgacacgacaatcgaccgtaagcgctataccagtacgaaagaagtgttggatgcgacccttattcaccagtcaattacaggattatatgagacccgtatcgaccttagccaattaggtggggatgcgccagcgcctgctcctgcacccgctccagctcctgcgccagctcctgcacctgcgatggtgagcaaaggtgaagaggataatatggccatcatcaaagaattcatgcgcttcaaagttcatatggaaggtagcgttaatggccacgaatttgaaattgaaggtgaaggcgaaggtcgtccgtatgaaggcacccagaccgcaaaactgaaagttaccaaaggtggtccgctgccgtttgcatgggatattctgagtccgcagtttatgtatggtagcaaagcctatgttaaacatccggcagatatcccggattatctgaaactgagctttccggaaggttttaaatgggaacgtgtgatgaattttgaagatggtggtgttgttaccgttacacaggatagcagcctgcaggatggtgaatttatctataaagttaaactgcgtggcacgaattttccgagtgatggtccggttatgcagaaaaaaaccatgggttgggaagcaagcagcgaacgtatgtatccggaagatggcgcactgaaaggtgaaattaaacagcgtctgaagctgaaagatggcggtcattatgatgcagaagttaaaaccacctacaaagccaaaaaaccggttcagctgcctggtgcatataacgttaacattaaactggatatcaccagccacaacgaggattataccattgttgaacagtatgaacgtgcagaaggtcgccatagtaccggtggtatggatgaactgtataaa

SEQ ID NO: 383 - DNA, 4875 bp, Artificial Sequence
  SYNTHETIC
atggacaaaaagtactctattggcctggatatcgggaccaacagcgtcgggtgggctgttatcaccgacgagtataaagtaccttcgaaaaagttcaaagtgctgggcaacaccgatcgccattcaatcaaaaagaacttgattggtgcgctgttgtttgactccggggaaaccgccgaggcgactcgccttaaacgtacagcacgtcgccggtacactcggcgtaagaatcgcatttgctatttgcaggaaatctttagcaacgagatggcaaaagtcgatgactcgtttttccaccgcctcgaggaaagctttctggtggaggaagacaaaaagcatgagcgtcacccgatcttcggcaacattgtcgatgaagtagcgtatcatgaaaaatacccaaccatttaccacttacgcaaaaagctggtggacagcactgacaaagctgatttgcgccttatctatttagccctggcacatatgattaagtttcgtggtcacttcctgatcgaaggagacttaaatcccgacaacagtgatgttgataaattgtttattcagcttgtccaaacttacaatcaactgttcgaggaaaacccgatcaatgcctccggtgtggatgcaaaagccattttaagtgcacgccttagcaagtcccgtcgcttagaaaaccttatcgcgcagctgcccggcgagaaaaagaatggtttgtttgggaaccttattgccttgagcttaggcctcaccccgaatttcaaaagtaatttcgatcttgcagaagacgccaaattacaactgtcgaaggatacttatgatgacgatctcgataatctgttagcgcagattggtgaccaatacgccgatctttttctggcggctaaaaatctgagcgacgccatcttgctttcggatattctccgcgttaacaccgaaatcacgaaagcgcctcttagtgccagcatgattaaacgttatgatgaacaccaccaggacctgaccttactcaaagcgttggttcgccagcaactgccagagaagtacaaagaaatcttctttgatcagtcaaagaatggttatgccggctatattgacgggggtgcaagccaagaggaattctacaaatttatcaagcctattctggagaaaatggatggcaccgaagagttattggtgaagcttaaccgtgaagacctcctgcggaaacagcgcacattcgataatggttcgatcccacaccaaatccatttgggggagttacacgctattttgcgtcgccaggaagacttttaccctttcctgaaggataaccgggagaaaattgagaagatccttacctttcgtattccgtattacgtaggccccttagcacggggtaatagccgtttcgcgtggatgacacggaagtcggaagagacgatcaccccgtggaacttcgaagaggtagtcgacaagggcgcatcagcgcagtcttttattgaacgtatgacgaatttcgataaaaacttgcccaatgagaaggtgcttccgaaacattccttgttatatgaatattttacagtttacaacgagctgaccaaggttaaatacgtgacggaaggaatgcgcaagcccgcttttcttagcggtgagcaaaaaaaggcgatcgtcgacctgttattcaaaacgaatcgtaaggtgactgtaaagcaactcaaagaagattacttcaaaaagattgagtgcttcgacagcgtcgaaatctctggggtagaggatcggtttaacgcaagtttaggtacctaccatgacctgcttaaaatcattaaggataaagacttcttagataatgaagagaacgaagatattctcgaggacatcgtcttgacgttaaccttatttgaggatcgtgaaatgattgaggaacgcctcaaaacttatgcccacctgttcgacgataaggtgatgaagcagctgaaacgtcggcgctacacaggatggggccgcttgagtcgcaaacttattaacggaatccgtgacaagcaatccggcaaaacgattctggatttcttgaagtcggacggatttgctaatcgcaacttcatgcagttgatccatgatgactccctgacttttaaagaggatattcaaaaggcgcaggttagtggtcaaggcgacagcttacacgaacacatcgcaaatttggctggttcgccggccattaaaaaggggatcctccagaccgtgaaagttgtagatgagcttgttaaggtcatgggtcgtcataagcccgaaaacatcgtgattgaaatggcgcgggagaatcaaacgacccagaaaggacaaaagaatagccgtgaacggatgaagcggatcgaggaaggcattaaagagctggggtctcaaatcttgaaggaacaccctgtggagaacactcagctccaaaatgaaaaactttacctgtactatttgcagaacggacgcgatatgtacgtggaccaagagttggatattaatcggctgagtgactacgacgttgatcatatcgtcccgcagagcttcctcaaagacgattctattgacaataaggtactgacgcgctctgataaaaaccgtggtaagtcggacaacgtgccctccgaagaggttgtgaaaaagatgaaaaattattggcgccagcttttaaacgcgaagctgatcacacaacgtaaattcgataatttgaccaaggctgaacggggtggcctgagcgagttagataaggcaggatttattaaacgccagttagtggagactcgtcaaatcaccaaacatgtcgcgcagattttggacagccggatgaacaccaagtacgatgaaaatgacaaactgatccgtgaggtgaaagtcattactctgaagtccaaattagttagtgatttccggaaggactttcaattctacaaagtccgtgaaattaataactatcatcacgcacatgacgcgtacctgaatgcagtggttgggaccgcccttatcaagaaatatcctaagctggagtcggagtttgtctatggcgactataaggtatacgatgttcgcaaaatgattgcgaaatctgagcaggagatcggtaaggcaaccgcaaaatatttcttttactcaaacattatgaatttctttaagacagaaatcactctggccaacggggagattcgcaaacgtccgttgatcgaaacaaacggcgagactggcgaaattgtttgggacaaagggcgtgatttcgcgacggtgcgcaaggtactgagcatgcctcaagtcaatattgttaagaaaaccgaagtgcagacgggcgggttttccaaggaaagcatcttacccaaacgtaattcagataaacttattgcacgcaaaaaggactgggatccgaaaaagtatggaggcttcgacagtccaaccgtagcctactctgttctcgttgtagcgaaagtagaaaagggtaaatccaagaaactgaaatctgtcaaggagttgcttggaatcaccattatggagcgtagctccttcgagaagaacccgattgactttctggaagccaaaggatataaagaggtcaagaaagatcttatcattaagctgcctaagtattcactcttcgagctggaaaatggtcgtaaacgcatgctcgcttctgccggcgagttgcagaagggcaatgaattagcacttccatcaaagtacgttaacttcctgtatttggccagccattacgagaaactgaaggggtctccagaggacaacgaacagaaacaattatttgtagagcagcacaagcattatcttgatgaaatcattgagcaaatttccgaattcagtaaacgcgtaatcctggccgatgcaaacctcgacaaggtgctgagcgcttacaataagcatcgcgacaaacctatccgtgagcaggctgaaaatatcattcacctgttcacattaacgaacctgggcgctccggccgcttttaaatatttcgacacgacaatcgaccgtaagcgctataccagtacgaaagaagtgttggatgcgacccttattcaccagtcaattacaggattatatgagacccgtatcgaccttagccaattaggtggggatgcgccagcgcctgctcctgcacccgctccagctcctgctcctgcgccagctcctgcacctgcgatggtgagcaaaggtgaagaggataatatggccatcatcaaagaattcatgcgcttcaaagttcatatggaaggtagcgttaatggccacgaatttgaaattgaaggtgaaggcgaaggtcgtccgtatgaaggcacccagaccgcaaaactgaaagttaccaaaggtggtccgctgccgtttgcatgggatattctgagtccgcagtttatgtatggtagcaaagcctatgttaaacatccggcagatatcccggattatctgaaactgagctttccggaaggttttaaatgggaacgtgtgatgaattttgaagatggtggtgttgttaccgttacacaggatagcagcctgcaggatggtgaatttatctataaagttaaactgcgtggcacgaattttccgagtgatggtccggttatgcagaaaaaaaccatgggttgggaagcaagcagcgaacgtatgtatccggaagatggcgcactgaaaggtgaaattaaacagcgtctgaagctgaaagatggcggtcattatgatgcagaagttaaaaccacctacaaagccaaaaaaccggttcagctgcctggtgcatataacgttaacattaaactggatatcaccagccacaacgaggattataccattgttgaacagtatgaacgtgcagaaggtcgccatagtaccggtggtatggatgaactgtataaa

SEQ ID NO: 384 - DNA, 4881 bp, Artificial Sequence
  SYNTHETIC
atggacaaaaagtactctattggcctggatatcgggaccaacagcgtcgggtgggctgttatcaccgacgagtataaagtaccttcgaaaaagttcaaagtgctgggcaacaccgatcgccattcaatcaaaaagaacttgattggtgcgctgttgtttgactccggggaaaccgccgaggcgactcgccttaaacgtacagcacgtcgccggtacactcggcgtaagaatcgcatttgctatttgcaggaaatctttagcaacgagatggcaaaagtcgatgactcgtttttccaccgcctcgaggaaagctttctggtggaggaagacaaaaagcatgagcgtcacccgatcttcggcaacattgtcgatgaagtagcgtatcatgaaaaatacccaaccatttaccacttacgcaaaaagctggtggacagcactgacaaagctgatttgcgccttatctatttagccctggcacatatgattaagtttcgtggtcacttcctgatcgaaggagacttaaatcccgacaacagtgatgttgataaattgtttattcagcttgtccaaacttacaatcaactgttcgaggaaaacccgatcaatgcctccggtgtggatgcaaaagccattttaagtgcacgccttagcaagtcccgtcgcttagaaaaccttatcgcgcagctgcccggcgagaaaaagaatggtttgtttgggaaccttattgccttgagcttaggcctcaccccgaatttcaaaagtaatttcgatcttgcagaagacgccaaattacaactgtcgaaggatacttatgatgacgatctcgataatctgttagcgcagattggtgaccaatacgccgatctttttctggcggctaaaaatctgagcgacgccatcttgctttcggatattctccgcgttaacaccgaaatcacgaaagcgcctcttagtgccagcatgattaaacgttatgatgaacaccaccaggacctgaccttactcaaagcgttggttcgccagcaactgccagagaagtacaaagaaatcttctttgatcagtcaaagaatggttatgccggctatattgacgggggtgcaagccaagaggaattctacaaatttatcaagcctattctggagaaaatggatggcaccgaagagttattggtgaagcttaaccgtgaagacctcctgcggaaacagcgcacattcgataatggttcgatcccacaccaaatccatttgggggagttacacgctattttgcgtcgccaggaagacttttaccctttcctgaaggataaccgggagaaaattgagaagatccttacctttcgtattccgtattacgtaggccccttagcacggggtaatagccgtttcgcgtggatgacacggaagtcggaagagacgatcaccccgtggaacttcgaagaggtagtcgacaagggcgcatcagcgcagtcttttattgaacgtatgacgaatttcgataaaaacttgcccaatgagaaggtgcttccgaaacattccttgttatatgaatattttacagtttacaacgagctgaccaaggttaaatacgtgacggaaggaatgcgcaagcccgcttttcttagcggtgagcaaaaaaaggcgatcgtcgacctgttattcaaaacgaatcgtaaggtgactgtaaagcaactcaaagaagattacttcaaaaagattgagtgcttcgacagcgtcgaaatctctggggtagaggatcggtttaacgcaagtttaggtacctaccatgacctgcttaaaatcattaaggataaagacttcttagataatgaagagaacgaagatattctcgaggacatcgtcttgacgttaaccttatttgaggatcgtgaaatgattgaggaacgcctcaaaacttatgcccacctgttcgacgataaggtgatgaagcagctgaaacgtcggcgctacacaggatggggccgcttgagtcgcaaacttattaacggaatccgtgacaagcaatccggcaaaacgattctggatttcttgaagtcggacggatttgctaatcgcaacttcatgcagttgatccatgatgactccctgacttttaaagaggatattcaaaaggcgcaggttagtggtcaaggcgacagcttacacgaacacatcgcaaatttggctggttcgccggccattaaaaaggggatcctccagaccgtgaaagttgtagatgagcttgttaaggtcatgggtcgtcataagcccgaaaacatcgtgattgaaatggcgcgggagaatcaaacgacccagaaaggacaaaagaatagccgtgaacggatgaagcggatcgaggaaggcattaaagagctggggtctcaaatcttgaaggaacaccctgtggagaacactcagctccaaaatgaaaaactttacctgtactatttgcagaacggacgcgatatgtacgtggaccaagagttggatattaatcggctgagtgactacgacgttgatcatatcgtcccgcagagcttcctcaaagacgattctattgacaataaggtactgacgcgctctgataaaaaccgtggtaagtcggacaacgtgccctccgaagaggttgtgaaaaagatgaaaaattattggcgccagcttttaaacgcgaagctgatcacacaacgtaaattcgataatttgaccaaggctgaacggggtggcctgagcgagttagataaggcaggatttattaaacgccagttagtggagactcgtcaaatcaccaaacatgtcgcgcagattttggacagccggatgaacaccaagtacgatgaaaatgacaaactgatccgtgaggtgaaagtcattactctgaagtccaaattagttagtgatttccggaaggactttcaattctacaaagtccgtgaaattaataactatcatcacgcacatgacgcgtacctgaatgcagtggttgggaccgcccttatcaagaaatatcctaagctggagtcggagtttgtctatggcgactataaggtatacgatgttcgcaaaatgattgcgaaatctgagcaggagatcggtaaggcaaccgcaaaatatttcttttactcaaacattatgaatttctttaagacagaaatcactctggccaacggggagattcgcaaacgtccgttgatcgaaacaaacggcgagactggcgaaattgtttgggacaaagggcgtgatttcgcgacggtgcgcaaggtactgagcatgcctcaagtcaatattgttaagaaaaccgaagtgcagacgggcgggttttccaaggaaagcatcttacccaaacgtaattcagataaacttattgcacgcaaaaaggactgggatccgaaaaagtatggaggcttcgacagtccaaccgtagcctactctgttctcgttgtagcgaaagtagaaaagggtaaatccaagaaactgaaatctgtcaaggagttgcttggaatcaccattatggagcgtagctccttcgagaagaacccgattgactttctggaagccaaaggatataaagaggtcaagaaagatcttatcattaagctgcctaagtattcactcttcgagctggaaaatggtcgtaaacgcatgctcgcttctgccggcgagttgcagaagggcaatgaattagcacttccatcaaagtacgttaacttcctgtatttggccagccattacgagaaactgaaggggtctccagaggacaacgaacagaaacaattatttgtagagcagcacaagcattatcttgatgaaatcattgagcaaatttccgaattcagtaaacgcgtaatcctggccgatgcaaacctcgacaaggtgctgagcgcttacaataagcatcgcgacaaacctatccgtgagcaggctgaaaatatcattcacctgttcacattaacgaacctgggcgctccggccgcttttaaatatttcgacacgacaatcgaccgtaagcgctataccagtacgaaagaagtgttggatgcgacccttattcaccagtcaattacaggattatatgagacccgtatcgaccttagccaattaggtggggatgcgccagcgcctgctcctgcacccgctccagctcctgccccagctccagcgcccgctcctgcacctgcgatggtgagcaaaggtgaagaggataatatggccatcatcaaagaattcatgcgcttcaaagttcatatggaaggtagcgttaatggccacgaatttgaaattgaaggtgaaggcgaaggtcgtccgtatgaaggcacccagaccgcaaaactgaaagttaccaaaggtggtccgctgccgtttgcatgggatattctgagtccgcagtttatgtatggtagcaaagcctatgttaaacatccggcagatatcccggattatctgaaactgagctttccggaaggttttaaatgggaacgtgtgatgaattttgaagatggtggtgttgttaccgttacacaggatagcagcctgcaggatggtgaatttatctataaagttaaactgcgtggcacgaattttccgagtgatggtccggttatgcagaaaaaaaccatgggttgggaagcaagcagcgaacgtatgtatccggaagatggcgcactgaaaggtgaaattaaacagcgtctgaagctgaaagatggcggtcattatgatgcagaagttaaaaccacctacaaagccaaaaaaccggttcagctgcctggtgcatataacgttaacattaaactggatatcaccagccacaacgaggattataccattgttgaacagtatgaacgtgcagaaggtcgccatagtaccggtggtatggatgaactgtataaa

SEQ ID NO: 385 - DNA, 4887 bp, Artificial Sequence
  SYNTHETIC
atggacaaaaagtactctattggcctggatatcgggaccaacagcgtcgggtgggctgttatcaccgacgagtataaagtaccttcgaaaaagttcaaagtgctgggcaacaccgatcgccattcaatcaaaaagaacttgattggtgcgctgttgtttgactccggggaaaccgccgaggcgactcgccttaaacgtacagcacgtcgccggtacactcggcgtaagaatcgcatttgctatttgcaggaaatctttagcaacgagatggcaaaagtcgatgactcgtttttccaccgcctcgaggaaagctttctggtggaggaagacaaaaagcatgagcgtcacccgatcttcggcaacattgtcgatgaagtagcgtatcatgaaaaatacccaaccatttaccacttacgcaaaaagctggtggacagcactgacaaagctgatttgcgccttatctatttagccctggcacatatgattaagtttcgtggtcacttcctgatcgaaggagacttaaatcccgacaacagtgatgttgataaattgtttattcagcttgtccaaacttacaatcaactgttcgaggaaaacccgatcaatgcctccggtgtggatgcaaaagccattttaagtgcacgccttagcaagtcccgtcgcttagaaaaccttatcgcgcagctgcccggcgagaaaaagaatggtttgtttgggaaccttattgccttgagcttaggcctcaccccgaatttcaaaagtaatttcgatcttgcagaagacgccaaattacaactgtcgaaggatacttatgatgacgatctcgataatctgttagcgcagattggtgaccaatacgccgatctttttctggcggctaaaaatctgagcgacgccatcttgctttcggatattctccgcgttaacaccgaaatcacgaaagcgcctcttagtgccagcatgattaaacgttatgatgaacaccaccaggacctgaccttactcaaagcgttggttcgccagcaactgccagagaagtacaaagaaatcttctttgatcagtcaaagaatggttatgccggctatattgacgggggtgcaagccaagaggaattctacaaatttatcaagcctattctggagaaaatggatggcaccgaagagttattggtgaagcttaaccgtgaagacctcctgcggaaacagcgcacattcgataatggttcgatcccacaccaaatccatttgggggagttacacgctattttgcgtcgccaggaagacttttaccctttcctgaaggataaccgggagaaaattgagaagatccttacctttcgtattccgtattacgtaggccccttagcacggggtaatagccgtttcgcgtggatgacacggaagtcggaagagacgatcaccccgtggaacttcgaagaggtagtcgacaagggcgcatcagcgcagtcttttattgaacgtatgacgaatttcgataaaaacttgcccaatgagaaggtgcttccgaaacattccttgttatatgaatattttacagtttacaacgagctgaccaaggttaaatacgtgacggaaggaatgcgcaagcccgcttttcttagcggtgagcaaaaaaaggcgatcgtcgacctgttattcaaaacgaatcgtaaggtgactgtaaagcaactcaaagaagattacttcaaaaagattgagtgcttcgacagcgtcgaaatctctggggtagaggatcggtttaacgcaagtttaggtacctaccatgacctgcttaaaatcattaaggataaagacttcttagataatgaagagaacgaagatattctcgaggacatcgtcttgacgttaaccttatttgaggatcgtgaaatgattgaggaacgcctcaaaacttatgcccacctgttcgacgataaggtgatgaagcagctgaaacgtcggcgctacacaggatggggccgcttgagtcgcaaacttattaacggaatccgtgacaagcaatccggcaaaacgattctggatttcttgaagtcggacggatttgctaatcgcaacttcatgcagttgatccatgatgactccctgacttttaaagaggatattcaaaaggcgcaggttagtggtcaaggcgacagcttacacgaacacatcgcaaatttggctggttcgccggccattaaaaaggggatcctccagaccgtgaaagttgtagatgagcttgttaaggtcatgggtcgtcataagcccgaaaacatcgtgattgaaatggcgcgggagaatcaaacgacccagaaaggacaaaagaatagccgtgaacggatgaagcggatcgaggaaggcattaaagagctggggtctcaaatcttgaaggaacaccctgtggagaacactcagctccaaaatgaaaaactttacctgtactatttgcagaacggacgcgatatgtacgtggaccaagagttggatattaatcggctgagtgactacgacgttgatcatatcgtcccgcagagcttcctcaaagacgattctattgacaataaggtactgacgcgctctgataaaaaccgtggtaagtcggacaacgtgccctccgaagaggttgtgaaaaagatgaaaaattattggcgccagcttttaaacgcgaagctgatcacacaacgtaaattcgataatttgaccaaggctgaacggggtggcctgagcgagttagataaggcaggatttattaaacgccagttagtggagactcgtcaaatcaccaaacatgtcgcgcagattttggacagccggatgaacaccaagtacgatgaaaatgacaaactgatccgtgaggtgaaagtcattactctgaagtccaaattagttagtgatttccggaaggactttcaattctacaaagtccgtgaaattaataactatcatcacgcacatgacgcgtacctgaatgcagtggttgggaccgcccttatcaagaaatatcctaagctggagtcggagtttgtctatggcgactataaggtatacgatgttcgcaaaatgattgcgaaatctgagcaggagatcggtaaggcaaccgcaaaatatttcttttactcaaacattatgaatttctttaagacagaaatcactctggccaacggggagattcgcaaacgtccgttgatcgaaacaaacggcgagactggcgaaattgtttgggacaaagggcgtgatttcgcgacggtgcgcaaggtactgagcatgcctcaagtcaatattgttaagaaaaccgaagtgcagacgggcgggttttccaaggaaagcatcttacccaaacgtaattcagataaacttattgcacgcaaaaaggactgggatccgaaaaagtatggaggcttcgacagtccaaccgtagcctactctgttctcgttgtagcgaaagtagaaaagggtaaatccaagaaactgaaatctgtcaaggagttgcttggaatcaccattatggagcgtagctccttcgagaagaacccgattgactttctggaagccaaaggatataaagaggtcaagaaagatcttatcattaagctgcctaagtattcactcttcgagctggaaaatggtcgtaaacgcatgctcgcttctgccggcgagttgcagaagggcaatgaattagcacttccatcaaagtacgttaacttcctgtatttggccagccattacgagaaactgaaggggtctccagaggacaacgaacagaaacaattatttgtagagcagcacaagcattatcttgatgaaatcattgagcaaatttccgaattcagtaaacgcgtaatcctggccgatgcaaacctcgacaaggtgctgagcgcttacaataagcatcgcgacaaacctatccgtgagcaggctgaaaatatcattcacctgttcacattaacgaacctgggcgctccggccgcttttaaatatttcgacacgacaatcgaccgtaagcgctataccagtacgaaagaagtgttggatgcgacccttattcaccagtcaattacaggattatatgagacccgtatcgaccttagccaattaggtggggatgcgccagcgcctgctcctgcacccgctccagctcctgccccagctccagcgcccgctcctgctcctgcacctgcgatggtgagcaaaggtgaagaggataatatggccatcatcaaagaattcatgcgcttcaaagttcatatggaaggtagcgttaatggccacgaatttgaaattgaaggtgaaggcgaaggtcgtccgtatgaaggcacccagaccgcaaaactgaaagttaccaaaggtggtccgctgccgtttgcatgggatattctgagtccgcagtttatgtatggtagcaaagcctatgttaaacatccggcagatatcccggattatctgaaactgagctttccggaaggttttaaatgggaacgtgtgatgaattttgaagatggtggtgttgttaccgttacacaggatagcagcctgcaggatggtgaatttatctataaagttaaactgcgtggcacgaattttccgagtgatggtccggttatgcagaaaaaaaccatgggttgggaagcaagcagcgaacgtatgtatccggaagatggcgcactgaaaggtgaaattaaacagcgtctgaagctgaaagatggcggtcattatgatgcagaagttaaaaccacctacaaagccaaaaaaccggttcagctgcctggtgcatataacgttaacattaaactggatatcaccagccacaacgaggattataccattgttgaacagtatgaacgtgcagaaggtcgccatagtaccggtggtatggatgaactgtataaa

SEQ ID NO: 386 - DNA, 4893 bp, Artificial Sequence
  SYNTHETIC
atggacaaaaagtactctattggcctggatatcgggaccaacagcgtcgggtgggctgttatcaccgacgagtataaagtaccttcgaaaaagttcaaagtgctgggcaacaccgatcgccattcaatcaaaaagaacttgattggtgcgctgttgtttgactccggggaaaccgccgaggcgactcgccttaaacgtacagcacgtcgccggtacactcggcgtaagaatcgcatttgctatttgcaggaaatctttagcaacgagatggcaaaagtcgatgactcgtttttccaccgcctcgaggaaagctttctggtggaggaagacaaaaagcatgagcgtcacccgatcttcggcaacattgtcgatgaagtagcgtatcatgaaaaatacccaaccatttaccacttacgcaaaaagctggtggacagcactgacaaagctgatttgcgccttatctatttagccctggcacatatgattaagtttcgtggtcacttcctgatcgaaggagacttaaatcccgacaacagtgatgttgataaattgtttattcagcttgtccaaacttacaatcaactgttcgaggaaaacccgatcaatgcctccggtgtggatgcaaaagccattttaagtgcacgccttagcaagtcccgtcgcttagaaaaccttatcgcgcagctgcccggcgagaaaaagaatggtttgtttgggaaccttattgccttgagcttaggcctcaccccgaatttcaaaagtaatttcgatcttgcagaagacgccaaattacaactgtcgaaggatacttatgatgacgatctcgataatctgttagcgcagattggtgaccaatacgccgatctttttctggcggctaaaaatctgagcgacgccatcttgctttcggatattctccgcgttaacaccgaaatcacgaaagcgcctcttagtgccagcatgattaaacgttatgatgaacaccaccaggacctgaccttactcaaagcgttggttcgccagcaactgccagagaagtacaaagaaatcttctttgatcagtcaaagaatggttatgccggctatattgacgggggtgcaagccaagaggaattctacaaatttatcaagcctattctggagaaaatggatggcaccgaagagttattggtgaagcttaaccgtgaagacctcctgcggaaacagcgcacattcgataatggttcgatcccacaccaaatccatttgggggagttacacgctattttgcgtcgccaggaagacttttaccctttcctgaaggataaccgggagaaaattgagaagatccttacctttcgtattccgtattacgtaggccccttagcacggggtaatagccgtttcgcgtggatgacacggaagtcggaagagacgatcaccccgtggaacttcgaagaggtagtcgacaagggcgcatcagcgcagtcttttattgaacgtatgacgaatttcgataaaaacttgcccaatgagaaggtgcttccgaaacattccttgttatatgaatattttacagtttacaacgagctgaccaaggttaaatacgtgacggaaggaatgcgcaagcccgcttttcttagcggtgagcaaaaaaaggcgatcgtcgacctgttattcaaaacgaatcgtaaggtgactgtaaagcaactcaaagaagattacttcaaaaagattgagtgcttcgacagcgtcgaaatctctggggtagaggatcggtttaacgcaagtttaggtacctaccatgacctgcttaaaatcattaaggataaagacttcttagataatgaagagaacgaagatattctcgaggacatcgtcttgacgttaaccttatttgaggatcgtgaaatgattgaggaacgcctcaaaacttatgcccacctgttcgacgataaggtgatgaagcagctgaaacgtcggcgctacacaggatggggccgcttgagtcgcaaacttattaacggaatccgtgacaagcaatccggcaaaacgattctggatttcttgaagtcggacggatttgctaatcgcaacttcatgcagttgatccatgatgactccctgacttttaaagaggatattcaaaaggcgcaggttagtggtcaaggcgacagcttacacgaacacatcgcaaatttggctggttcgccggccattaaaaaggggatcctccagaccgtgaaagttgtagatgagcttgttaaggtcatgggtcgtcataagcccgaaaacatcgtgattgaaatggcgcgggagaatcaaacgacccagaaaggacaaaagaatagccgtgaacggatgaagcggatcgaggaaggcattaaagagctggggtctcaaatcttgaaggaacaccctgtggagaacactcagctccaaaatgaaaaactttacctgtactatttgcagaacggacgcgatatgtacgtggaccaagagttggatattaatcggctgagtgactacgacgttgatcatatcgtcccgcagagcttcctcaaagacgattctattgacaataaggtactgacgcgctctgataaaaaccgtggtaagtcggacaacgtgccctccgaagaggttgtgaaaaagatgaaaaattattggcgccagcttttaaacgcgaagctgatcacacaacgtaaattcgataatttgaccaaggctgaacggggtggcctgagcgagttagataaggcaggatttattaaacgccagttagtggagactcgtcaaatcaccaaacatgtcgcgcagattttggacagccggatgaacaccaagtacgatgaaaatgacaaactgatccgtgaggtgaaagtcattactctgaagtccaaattagttagtgatttccggaaggactttcaattctacaaagtccgtgaaattaataactatcatcacgcacatgacgcgtacctgaatgcagtggttgggaccgcccttatcaagaaatatcctaagctggagtcggagtttgtctatggcgactataaggtatacgatgttcgcaaaatgattgcgaaatctgagcaggagatcggtaaggcaaccgcaaaatatttcttttactcaaacattatgaatttctttaagacagaaatcactctggccaacggggagattcgcaaacgtccgttgatcgaaacaaacggcgagactggcgaaattgtttgggacaaagggcgtgatttcgcgacggtgcgcaaggtactgagcatgcctcaagtcaatattgttaagaaaaccgaagtgcagacgggcgggttttccaaggaaagcatcttacccaaacgtaattcagataaacttattgcacgcaaaaaggactgggatccgaaaaagtatggaggcttcgacagtccaaccgtagcctactctgttctcgttgtagcgaaagtagaaaagggtaaatccaagaaactgaaatctgtcaaggagttgcttggaatcaccattatggagcgtagctccttcgagaagaacccgattgactttctggaagccaaaggatataaagaggtcaagaaagatcttatcattaagctgcctaagtattcactcttcgagctggaaaatggtcgtaaacgcatgctcgcttctgccggcgagttgcagaagggcaatgaattagcacttccatcaaagtacgttaacttcctgtatttggccagccattacgagaaactgaaggggtctccagaggacaacgaacagaaacaattatttgtagagcagcacaagcattatcttgatgaaatcattgagcaaatttccgaattcagtaaacgcgtaatcctggccgatgcaaacctcgacaaggtgctgagcgcttacaataagcatcgcgacaaacctatccgtgagcaggctgaaaatatcattcacctgttcacattaacgaacctgggcgctccggccgcttttaaatatttcgacacgacaatcgaccgtaagcgctataccagtacgaaagaagtgttggatgcgacccttattcaccagtcaattacaggattatatgagacccgtatcgaccttagccaattaggtggggatgcgccagcgcctgctcctgcacccgctccagctcctgccccagctccagcgcccgctcctgcgccagctcctgcacctgcgatggtgagcaaaggtgaagaggataatatggccatcatcaaagaattcatgcgcttcaaagttcatatggaaggtagcgttaatggccacgaatttgaaattgaaggtgaaggcgaaggtcgtccgtatgaaggcacccagaccgcaaaactgaaagttaccaaaggtggtccgctgccgtttgcatgggatattctgagtccgcagtttatgtatggtagcaaagcctatgttaaacatccggcagatatcccggattatctgaaactgagctttccggaaggttttaaatgggaacgtgtgatgaattttgaagatggtggtgttgttaccgttacacaggatagcagcctgcaggatggtgaatttatctataaagttaaactgcgtggcacgaattttccgagtgatggtccggttatgcagaaaaaaaccatgggttgggaagcaagcagcgaacgtatgtatccggaagatggcgcactgaaaggtgaaattaaacagcgtctgaagctgaaagatggcggtcattatgatgcagaagttaaaaccacctacaaagccaaaaaaccggttcagctgcctggtgcatataacgttaacattaaactggatatcaccagccacaacgaggattataccattgttgaacagtatgaacgtgcagaaggtcgccatagtaccggtggtatggatgaactgtataaa

SEQ ID NO: 387 - DNA, 4899 bp, Artificial Sequence
  SYNTHETIC
atggacaaaaagtactctattggcctggatatcgggaccaacagcgtcgggtgggctgttatcaccgacgagtataaagtaccttcgaaaaagttcaaagtgctgggcaacaccgatcgccattcaatcaaaaagaacttgattggtgcgctgttgtttgactccggggaaaccgccgaggcgactcgccttaaacgtacagcacgtcgccggtacactcggcgtaagaatcgcatttgctatttgcaggaaatctttagcaacgagatggcaaaagtcgatgactcgtttttccaccgcctcgaggaaagctttctggtggaggaagacaaaaagcatgagcgtcacccgatcttcggcaacattgtcgatgaagtagcgtatcatgaaaaatacccaaccatttaccacttacgcaaaaagctggtggacagcactgacaaagctgatttgcgccttatctatttagccctggcacatatgattaagtttcgtggtcacttcctgatcgaaggagacttaaatcccgacaacagtgatgttgataaattgtttattcagcttgtccaaacttacaatcaactgttcgaggaaaacccgatcaatgcctccggtgtggatgcaaaagccattttaagtgcacgccttagcaagtcccgtcgcttagaaaaccttatcgcgcagctgcccggcgagaaaaagaatggtttgtttgggaaccttattgccttgagcttaggcctcaccccgaatttcaaaagtaatttcgatcttgcagaagacgccaaattacaactgtcgaaggatacttatgatgacgatctcgataatctgttagcgcagattggtgaccaatacgccgatctttttctggcggctaaaaatctgagcgacgccatcttgctttcggatattctccgcgttaacaccgaaatcacgaaagcgcctcttagtgccagcatgattaaacgttatgatgaacaccaccaggacctgaccttactcaaagcgttggttcgccagcaactgccagagaagtacaaagaaatcttctttgatcagtcaaagaatggttatgccggctatattgacgggggtgcaagccaagaggaattctacaaatttatcaagcctattctggagaaaatggatggcaccgaagagttattggtgaagcttaaccgtgaagacctcctgcggaaacagcgcacattcgataatggttcgatcccacaccaaatccatttgggggagttacacgctattttgcgtcgccaggaagacttttaccctttcctgaaggataaccgggagaaaattgagaagatccttacctttcgtattccgtattacgtaggccccttagcacggggtaatagccgtttcgcgtggatgacacggaagtcggaagagacgatcaccccgtggaacttcgaagaggtagtcgacaagggcgcatcagcgcagtcttttattgaacgtatgacgaatttcgataaaaacttgcccaatgagaaggtgcttccgaaacattccttgttatatgaatattttacagtttacaacgagctgaccaaggttaaatacgtgacggaaggaatgcgcaagcccgcttttcttagcggtgagcaaaaaaaggcgatcgtcgacctgttattcaaaacgaatcgtaaggtgactgtaaagcaactcaaagaagattacttcaaaaagattgagtgcttcgacagcgtcgaaatctctggggtagaggatcggtttaacgcaagtttaggtacctaccatgacctgcttaaaatcattaaggataaagacttcttagataatgaagagaacgaagatattctcgaggacatcgtcttgacgttaaccttatttgaggatcgtgaaatgattgaggaacgcctcaaaacttatgcccacctgttcgacgataaggtgatgaagcagctgaaacgtcggcgctacacaggatggggccgcttgagtcgcaaacttattaacggaatccgtgacaagcaatccggcaaaacgattctggatttcttgaagtcggacggatttgctaatcgcaacttcatgcagttgatccatgatgactccctgacttttaaagaggatattcaaaaggcgcaggttagtggtcaaggcgacagcttacacgaacacatcgcaaatttggctggttcgccggccattaaaaaggggatcctccagaccgtgaaagttgtagatgagcttgttaaggtcatgggtcgtcataagcccgaaaacatcgtgattgaaatggcgcgggagaatcaaacgacccagaaaggacaaaagaatagccgtgaacggatgaagcggatcgaggaaggcattaaagagctggggtctcaaatcttgaaggaacaccctgtggagaacactcagctccaaaatgaaaaactttacctgtactatttgcagaacggacgcgatatgtacgtggaccaagagttggatattaatcggctgagtgactacgacgttgatcatatcgtcccgcagagcttcctcaaagacgattctattgacaataaggtactgacgcgctctgataaaaaccgtggtaagtcggacaacgtgccctccgaagaggttgtgaaaaagatgaaaaattattggcgccagcttttaaacgcgaagctgatcacacaacgtaaattcgataatttgaccaaggctgaacggggtggcctgagcgagttagataaggcaggatttattaaacgccagttagtggagactcgtcaaatcaccaaacatgtcgcgcagattttggacagccggatgaacaccaagtacgatgaaaatgacaaactgatccgtgaggtgaaagtcattactctgaagtccaaattagttagtgatttccggaaggactttcaattctacaaagtccgtgaaattaataactatcatcacgcacatgacgcgtacctgaatgcagtggttgggaccgcccttatcaagaaatatcctaagctggagtcggagtttgtctatggcgactataaggtatacgatgttcgcaaaatgattgcgaaatctgagcaggagatcggtaaggcaaccgcaaaatatttcttttactcaaacattatgaatttctttaagacagaaatcactctggccaacggggagattcgcaaacgtccgttgatcgaaacaaacggcgagactggcgaaattgtttgggacaaagggcgtgatttcgcgacggtgcgcaaggtactgagcatgcctcaagtcaatattgttaagaaaaccgaagtgcagacgggcgggttttccaaggaaagcatcttacccaaacgtaattcagataaacttattgcacgcaaaaaggactgggatccgaaaaagtatggaggcttcgacagtccaaccgtagcctactctgttctcgttgtagcgaaagtagaaaagggtaaatccaagaaactgaaatctgtcaaggagttgcttggaatcaccattatggagcgtagctccttcgagaagaacccgattgactttctggaagccaaaggatataaagaggtcaagaaagatcttatcattaagctgcctaagtattcactcttcgagctggaaaatggtcgtaaacgcatgctcgcttctgccggcgagttgcagaagggcaatgaattagcacttccatcaaagtacgttaacttcctgtatttggccagccattacgagaaactgaaggggtctccagaggacaacgaacagaaacaattatttgtagagcagcacaagcattatcttgatgaaatcattgagcaaatttccgaattcagtaaacgcgtaatcctggccgatgcaaacctcgacaaggtgctgagcgcttacaataagcatcgcgacaaacctatccgtgagcaggctgaaaatatcattcacctgttcacattaacgaacctgggcgctccggccgcttttaaatatttcgacacgacaatcgaccgtaagcgctataccagtacgaaagaagtgttggatgcgacccttattcaccagtcaattacaggattatatgagacccgtatcgaccttagccaattaggtggggatgcgccagcgcctgctcctgcacccgctccagctcctgccccagctccagcgcccgctcctgcgccagctcctgcacctgctccagcgatggtgagcaaaggtgaagaggataatatggccatcatcaaagaattcatgcgcttcaaagttcatatggaaggtagcgttaatggccacgaatttgaaattgaaggtgaaggcgaaggtcgtccgtatgaaggcacccagaccgcaaaactgaaagttaccaaaggtggtccgctgccgtttgcatgggatattctgagtccgcagtttatgtatggtagcaaagcctatgttaaacatccggcagatatcccggattatctgaaactgagctttccggaaggttttaaatgggaacgtgtgatgaattttgaagatggtggtgttgttaccgttacacaggatagcagcctgcaggatggtgaatttatctataaagttaaactgcgtggcacgaattttccgagtgatggtccggttatgcagaaaaaaaccatgggttgggaagcaagcagcgaacgtatgtatccggaagatggcgcactgaaaggtgaaattaaacagcgtctgaagctgaaagatggcggtcattatgatgcagaagttaaaaccacctacaaagccaaaaaaccggttcagctgcctggtgcatataacgttaacattaaactggatatcaccagccacaacgaggattataccattgttgaacagtatgaacgtgcagaaggtcgccatagtaccggtggtatggatgaactgtataaa

SEQ ID NO: 388 - DNA, 4401 bp, Artificial Sequence
  SYNTHETIC
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatctgctgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacatatggttagcaaaggtgaagaactgtttaccggcgttgtgccgattctggtggaactggatggtgatgtgaatggccataaatttagcgttagcggcgaaggcgaaggtgatgcgacctatggtaaactgaccctgaaatttatttgcaccaccggtaaactgccggttccgtggccgaccctggtgaccaccctgacctatggcgttcagtgctttagccgctatccggatcatatgaaacagcatgatttctttaaaagcgcgatgccggaaggctatgtgcaggaacgtaccatttttttcaaagatgatggcaactataaaacccgtgcggaagttaaatttgaaggcgataccctggtgaaccgcattgaactgaaaggtattgattttaaagaagatggcaacattctgggtcataaactggaatataattacaacagccataatgtgtatattatggccgataaacagaaaaatggcatcaaagtgaactttaaaatccgtcacaacattgaagatggtagcgtgcagctggcggatcattatcagcagaataccccgattggtgatggcccggtgctgctgccggataatcattatctgagcacccagagcgcgctgagcaaagatccgaatgaaaaacgtgatcatatggtgctgctggaatttgttaccgccgcgggcattaccctgggtatggatgaactgtataaa

SEQ ID NO: 389 - DNA, 4437 bp, Artificial Sequence
  SYNTHETIC
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatctgctgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacatggtagcgcaggtagtgcagcaggtagcggtgaatttatggttagcaaaggtgaagaactgtttaccggcgttgtgccgattctggtggaactggatggtgatgtgaatggccataaatttagcgttagcggcgaaggcgaaggtgatgcgacctatggtaaactgaccctgaaatttatttgcaccaccggtaaactgccggttccgtggccgaccctggtgaccaccctgacctatggcgttcagtgctttagccgctatccggatcatatgaaacagcatgatttctttaaaagcgcgatgccggaaggctatgtgcaggaacgtaccatttttttcaaagatgatggcaactataaaacccgtgcggaagttaaatttgaaggcgataccctggtgaaccgcattgaactgaaaggtattgattttaaagaagatggcaacattctgggtcataaactggaatataattacaacagccataatgtgtatattatggccgataaacagaaaaatggcatcaaagtgaactttaaaatccgtcacaacattgaagatggtagcgtgcagctggcggatcattatcagcagaataccccgattggtgatggcccggtgctgctgccggataatcattatctgagcacccagagcgcgctgagcaaagatccgaatgaaaaacgtgatcatatggtgctgctggaatttgttaccgccgcgggcattaccctgggtatggatgaactgtataaa

SEQ ID NO: 390 - DNA, 4461 bp, Artificial Sequence
  SYNTHETIC
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatctgctgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacatggaggcggaggatcaggcggtggcggaagtggtggaggtgggtcgggaggtggtggtagcatggttagcaaaggtgaagaactgtttaccggcgttgtgccgattctggtggaactggatggtgatgtgaatggccataaatttagcgttagcggcgaaggcgaaggtgatgcgacctatggtaaactgaccctgaaatttatttgcaccaccggtaaactgccggttccgtggccgaccctggtgaccaccctgacctatggcgttcagtgctttagccgctatccggatcatatgaaacagcatgatttctttaaaagcgcgatgccggaaggctatgtgcaggaacgtaccatttttttcaaagatgatggcaactataaaacccgtgcggaagttaaatttgaaggcgataccctggtgaaccgcattgaactgaaaggtattgattttaaagaagatggcaacattctgggtcataaactggaatataattacaacagccataatgtgtatattatggccgataaacagaaaaatggcatcaaagtgaactttaaaatccgtcacaacattgaagatggtagcgtgcagctggcggatcattatcagcagaataccccgattggtgatggcccggtgctgctgccggataatcattatctgagcacccagagcgcgctgagcaaagatccgaatgaaaaacgtgatcatatggtgctgctggaatttgttaccgccgcgggcattaccctgggtatggatgaactgtataaa

SEQ ID NO: 391 - DNA, 4446 bp, Artificial Sequence
  SYNTHETIC
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatctgctgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacatggaggcggagggtcggaagcggcagcaaaaggaggcggaggaagtatggttagcaaaggtgaagaactgtttaccggcgttgtgccgattctggtggaactggatggtgatgtgaatggccataaatttagcgttagcggcgaaggcgaaggtgatgcgacctatggtaaactgaccctgaaatttatttgcaccaccggtaaactgccggttccgtggccgaccctggtgaccaccctgacctatggcgttcagtgctttagccgctatccggatcatatgaaacagcatgatttctttaaaagcgcgatgccggaaggctatgtgcaggaacgtaccatttttttcaaagatgatggcaactataaaacccgtgcggaagttaaatttgaaggcgataccctggtgaaccgcattgaactgaaaggtattgattttaaagaagatggcaacattctgggtcataaactggaatataattacaacagccataatgtgtatattatggccgataaacagaaaaatggcatcaaagtgaactttaaaatccgtcacaacattgaagatggtagcgtgcagctggcggatcattatcagcagaataccccgattggtgatggcccggtgctgctgccggataatcattatctgagcacccagagcgcgctgagcaaagatccgaatgaaaaacgtgatcatatggtgctgctggaatttgttaccgccgcgggcattaccctgggtatggatgaactgtataaa

SEQ ID NO: 392 - DNA, 4467 bp, Artificial Sequence
  SYNTHETIC
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatctgctgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacatgctgaggccgcagcaaaagaggctgccgctaaggaggctgctgcaaaagaagcagcagcgaaagctatggttagcaaaggtgaagaactgtttaccggcgttgtgccgattctggtggaactggatggtgatgtgaatggccataaatttagcgttagcggcgaaggcgaaggtgatgcgacctatggtaaactgaccctgaaatttatttgcaccaccggtaaactgccggttccgtggccgaccctggtgaccaccctgacctatggcgttcagtgctttagccgctatccggatcatatgaaacagcatgatttctttaaaagcgcgatgccggaaggctatgtgcaggaacgtaccatttttttcaaagatgatggcaactataaaacccgtgcggaagttaaatttgaaggcgataccctggtgaaccgcattgaactgaaaggtattgattttaaagaagatggcaacattctgggtcataaactggaatataattacaacagccataatgtgtatattatggccgataaacagaaaaatggcatcaaagtgaactttaaaatccgtcacaacattgaagatggtagcgtgcagctggcggatcattatcagcagaataccccgattggtgatggcccggtgctgctgccggataatcattatctgagcacccagagcgcgctgagcaaagatccgaatgaaaaacgtgatcatatggtgctgctggaatttgttaccgccgcgggcattaccctgggtatggatgaactgtataaa

SEQ ID NO: 393 - DNA, 4539 bp, Artificial Sequence
  SYNTHETIC
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatctgctgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacatgccgaagcagcagccaaagaagctgccgcaaaggaggcggcagctaaagaagcggccgctaaggcattggaagcggaggcggctgccaaggaggctgcggcgaaagaagctgcggccaaagaagcggctgcaaaagcgatggttagcaaaggtgaagaactgtttaccggcgttgtgccgattctggtggaactggatggtgatgtgaatggccataaatttagcgttagcggcgaaggcgaaggtgatgcgacctatggtaaactgaccctgaaatttatttgcaccaccggtaaactgccggttccgtggccgaccctggtgaccaccctgacctatggcgttcagtgctttagccgctatccggatcatatgaaacagcatgatttctttaaaagcgcgatgccggaaggctatgtgcaggaacgtaccatttttttcaaagatgatggcaactataaaacccgtgcggaagttaaatttgaaggcgataccctggtgaaccgcattgaactgaaaggtattgattttaaagaagatggcaacattctgggtcataaactggaatataattacaacagccataatgtgtatattatggccgataaacagaaaaatggcatcaaagtgaactttaaaatccgtcacaacattgaagatggtagcgtgcagctggcggatcattatcagcagaataccccgattggtgatggcccggtgctgctgccggataatcattatctgagcacccagagcgcgctgagcaaagatccgaatgaaaaacgtgatcatatggtgctgctggaatttgttaccgccgcgggcattaccctgggtatggatgaactgtataaa

SEQ ID NO: 394 - DNA, 4551 bp, Artificial Sequence
  SYNTHETIC
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatctgctgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacatttagaggctgaggctgctgccaaggaggctgctgcgaaggaagctgcagctaaagaggcagcggccaaagcacttgaggccgaagccgccgcgaaagaagccgctgctaaggaggcagccgccaaagaagcggcagctaaagcattagaaatggttagcaaaggtgaagaactgtttaccggcgttgtgccgattctggtggaactggatggtgatgtgaatggccataaatttagcgttagcggcgaaggcgaaggtgatgcgacctatggtaaactgaccctgaaatttatttgcaccaccggtaaactgccggttccgtggccgaccctggtgaccaccctgacctatggcgttcagtgctttagccgctatccggatcatatgaaacagcatgatttctttaaaagcgcgatgccggaaggctatgtgcaggaacgtaccatttttttcaaagatgatggcaactataaaacccgtgcggaagttaaatttgaaggcgataccctggtgaaccgcattgaactgaaaggtattgattttaaagaagatggcaacattctgggtcataaactggaatataattacaacagccataatgtgtatattatggccgataaacagaaaaatggcatcaaagtgaactttaaaatccgtcacaacattgaagatggtagcgtgcagctggcggatcattatcagcagaataccccgattggtgatggcccggtgctgctgccggataatcattatctgagcacccagagcgcgctgagcaaagatccgaatgaaaaacgtgatcatatggtgctgctggaatttgttaccgccgcgggcattaccctgggtatggatgaactgtataaa

SEQ ID NO: 395 - DNA, 4410 bp, Artificial Sequence
  SYNTHETIC
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatctgctgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacatgcacctgcgatggttagcaaaggtgaagaactgtttaccggcgttgtgccgattctggtggaactggatggtgatgtgaatggccataaatttagcgttagcggcgaaggcgaaggtgatgcgacctatggtaaactgaccctgaaatttatttgcaccaccggtaaactgccggttccgtggccgaccctggtgaccaccctgacctatggcgttcagtgctttagccgctatccggatcatatgaaacagcatgatttctttaaaagcgcgatgccggaaggctatgtgcaggaacgtaccatttttttcaaagatgatggcaactataaaacccgtgcggaagttaaatttgaaggcgataccctggtgaaccgcattgaactgaaaggtattgattttaaagaagatggcaacattctgggtcataaactggaatataattacaacagccataatgtgtatattatggccgataaacagaaaaatggcatcaaagtgaactttaaaatccgtcacaacattgaagatggtagcgtgcagctggcggatcattatcagcagaataccccgattggtgatggcccggtgctgctgccggataatcattatctgagcacccagagcgcgctgagcaaagatccgaatgaaaaacgtgatcatatggtgctgctggaatttgttaccgccgcgggcattaccctgggtatggatgaactgtataaa

SEQ ID NO: 396 - DNA, 4416 bp, Artificial Sequence
  SYNTHETIC
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatctgctgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacatgctcctgcacctgcgatggttagcaaaggtgaagaactgtttaccggcgttgtgccgattctggtggaactggatggtgatgtgaatggccataaatttagcgttagcggcgaaggcgaaggtgatgcgacctatggtaaactgaccctgaaatttatttgcaccaccggtaaactgccggttccgtggccgaccctggtgaccaccctgacctatggcgttcagtgctttagccgctatccggatcatatgaaacagcatgatttctttaaaagcgcgatgccggaaggctatgtgcaggaacgtaccatttttttcaaagatgatggcaactataaaacccgtgcggaagttaaatttgaaggcgataccctggtgaaccgcattgaactgaaaggtattgattttaaagaagatggcaacattctgggtcataaactggaatataattacaacagccataatgtgtatattatggccgataaacagaaaaatggcatcaaagtgaactttaaaatccgtcacaacattgaagatggtagcgtgcagctggcggatcattatcagcagaataccccgattggtgatggcccggtgctgctgccggataatcattatctgagcacccagagcgcgctgagcaaagatccgaatgaaaaacgtgatcatatggtgctgctggaatttgttaccgccgcgggcattaccctgggtatggatgaactgtataaa

SEQ ID NO: 397 - DNA, 4422 bp, Artificial Sequence
  SYNTHETIC
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatctgctgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacatgcgccagctcctgcacctgcgatggttagcaaaggtgaagaactgtttaccggcgttgtgccgattctggtggaactggatggtgatgtgaatggccataaatttagcgttagcggcgaaggcgaaggtgatgcgacctatggtaaactgaccctgaaatttatttgcaccaccggtaaactgccggttccgtggccgaccctggtgaccaccctgacctatggcgttcagtgctttagccgctatccggatcatatgaaacagcatgatttctttaaaagcgcgatgccggaaggctatgtgcaggaacgtaccatttttttcaaagatgatggcaactataaaacccgtgcggaagttaaatttgaaggcgataccctggtgaaccgcattgaactgaaaggtattgattttaaagaagatggcaacattctgggtcataaactggaatataattacaacagccataatgtgtatattatggccgataaacagaaaaatggcatcaaagtgaactttaaaatccgtcacaacattgaagatggtagcgtgcagctggcggatcattatcagcagaataccccgattggtgatggcccggtgctgctgccggataatcattatctgagcacccagagcgcgctgagcaaagatccgaatgaaaaacgtgatcatatggtgctgctggaatttgttaccgccgcgggcattaccctgggtatggatgaactgtataaa

SEQ ID NO: 398 - DNA, 4428 bp, Artificial Sequence
  SYNTHETIC
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatctgctgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacatgctcctgcgccagctcctgcacctgcgatggttagcaaaggtgaagaactgtttaccggcgttgtgccgattctggtggaactggatggtgatgtgaatggccataaatttagcgttagcggcgaaggcgaaggtgatgcgacctatggtaaactgaccctgaaatttatttgcaccaccggtaaactgccggttccgtggccgaccctggtgaccaccctgacctatggcgttcagtgctttagccgctatccggatcatatgaaacagcatgatttctttaaaagcgcgatgccggaaggctatgtgcaggaacgtaccatttttttcaaagatgatggcaactataaaacccgtgcggaagttaaatttgaaggcgataccctggtgaaccgcattgaactgaaaggtattgattttaaagaagatggcaacattctgggtcataaactggaatataattacaacagccataatgtgtatattatggccgataaacagaaaaatggcatcaaagtgaactttaaaatccgtcacaacattgaagatggtagcgtgcagctggcggatcattatcagcagaataccccgattggtgatggcccggtgctgctgccggataatcattatctgagcacccagagcgcgctgagcaaagatccgaatgaaaaacgtgatcatatggtgctgctggaatttgttaccgccgcgggcattaccctgggtatggatgaactgtataaa

SEQ ID NO: 399 - DNA, 4434 bp, Artificial Sequence
  SYNTHETIC
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatctgctgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacatgcgcccgctcctgcgccagctcctgcacctgcgatggttagcaaaggtgaagaactgtttaccggcgttgtgccgattctggtggaactggatggtgatgtgaatggccataaatttagcgttagcggcgaaggcgaaggtgatgcgacctatggtaaactgaccctgaaatttatttgcaccaccggtaaactgccggttccgtggccgaccctggtgaccaccctgacctatggcgttcagtgctttagccgctatccggatcatatgaaacagcatgatttctttaaaagcgcgatgccggaaggctatgtgcaggaacgtaccatttttttcaaagatgatggcaactataaaacccgtgcggaagttaaatttgaaggcgataccctggtgaaccgcattgaactgaaaggtattgattttaaagaagatggcaacattctgggtcataaactggaatataattacaacagccataatgtgtatattatggccgataaacagaaaaatggcatcaaagtgaactttaaaatccgtcacaacattgaagatggtagcgtgcagctggcggatcattatcagcagaataccccgattggtgatggcccggtgctgctgccggataatcattatctgagcacccagagcgcgctgagcaaagatccgaatgaaaaacgtgatcatatggtgctgctggaatttgttaccgccgcgggcattaccctgggtatggatgaactgtataaa

SEQ ID NO: 400 - DNA, 4440 bp, Artificial Sequence
  SYNTHETIC
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatctgctgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacatgcgccagcgcctgctcctgcacccgctccagcacctgcgatggttagcaaaggtgaagaactgtttaccggcgttgtgccgattctggtggaactggatggtgatgtgaatggccataaatttagcgttagcggcgaaggcgaaggtgatgcgacctatggtaaactgaccctgaaatttatttgcaccaccggtaaactgccggttccgtggccgaccctggtgaccaccctgacctatggcgttcagtgctttagccgctatccggatcatatgaaacagcatgatttctttaaaagcgcgatgccggaaggctatgtgcaggaacgtaccatttttttcaaagatgatggcaactataaaacccgtgcggaagttaaatttgaaggcgataccctggtgaaccgcattgaactgaaaggtattgattttaaagaagatggcaacattctgggtcataaactggaatataattacaacagccataatgtgtatattatggccgataaacagaaaaatggcatcaaagtgaactttaaaatccgtcacaacattgaagatggtagcgtgcagctggcggatcattatcagcagaataccccgattggtgatggcccggtgctgctgccggataatcattatctgagcacccagagcgcgctgagcaaagatccgaatgaaaaacgtgatcatatggtgctgctggaatttgttaccgccgcgggcattaccctgggtatggatgaactgtataaa

SEQ ID NO: 401 - DNA, 4446 bp, Artificial Sequence
  SYNTHETIC
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatctgctgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacatgcgccagcgcctgctcctgcacccgctccagctcctgccccagcgatggttagcaaaggtgaagaactgtttaccggcgttgtgccgattctggtggaactggatggtgatgtgaatggccataaatttagcgttagcggcgaaggcgaaggtgatgcgacctatggtaaactgaccctgaaatttatttgcaccaccggtaaactgccggttccgtggccgaccctggtgaccaccctgacctatggcgttcagtgctttagccgctatccggatcatatgaaacagcatgatttctttaaaagcgcgatgccggaaggctatgtgcaggaacgtaccatttttttcaaagatgatggcaactataaaacccgtgcggaagttaaatttgaaggcgataccctggtgaaccgcattgaactgaaaggtattgattttaaagaagatggcaacattctgggtcataaactggaatataattacaacagccataatgtgtatattatggccgataaacagaaaaatggcatcaaagtgaactttaaaatccgtcacaacattgaagatggtagcgtgcagctggcggatcattatcagcagaataccccgattggtgatggcccggtgctgctgccggataatcattatctgagcacccagagcgcgctgagcaaagatccgaatgaaaaacgtgatcatatggtgctgctggaatttgttaccgccgcgggcattaccctgggtatggatgaactgtataaa

SEQ ID NO: 402 - DNA, 4452 bp, Artificial Sequence
  SYNTHETIC
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatctgctgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacatgcgccagcgcctgctcctgcacccgctccagcgccagctcctgcacctgcgatggttagcaaaggtgaagaactgtttaccggcgttgtgccgattctggtggaactggatggtgatgtgaatggccataaatttagcgttagcggcgaaggcgaaggtgatgcgacctatggtaaactgaccctgaaatttatttgcaccaccggtaaactgccggttccgtggccgaccctggtgaccaccctgacctatggcgttcagtgctttagccgctatccggatcatatgaaacagcatgatttctttaaaagcgcgatgccggaaggctatgtgcaggaacgtaccatttttttcaaagatgatggcaactataaaacccgtgcggaagttaaatttgaaggcgataccctggtgaaccgcattgaactgaaaggtattgattttaaagaagatggcaacattctgggtcataaactggaatataattacaacagccataatgtgtatattatggccgataaacagaaaaatggcatcaaagtgaactttaaaatccgtcacaacattgaagatggtagcgtgcagctggcggatcattatcagcagaataccccgattggtgatggcccggtgctgctgccggataatcattatctgagcacccagagcgcgctgagcaaagatccgaatgaaaaacgtgatcatatggtgctgctggaatttgttaccgccgcgggcattaccctgggtatggatgaactgtataaa

SEQ ID NO: 403 - DNA, 4458 bp, Artificial Sequence
  SYNTHETIC
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatctgctgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacatgcgccagcgcctgctcctgcacccgctccagctcctgcgccagctcctgcacctgcgatggttagcaaaggtgaagaactgtttaccggcgttgtgccgattctggtggaactggatggtgatgtgaatggccataaatttagcgttagcggcgaaggcgaaggtgatgcgacctatggtaaactgaccctgaaatttatttgcaccaccggtaaactgccggttccgtggccgaccctggtgaccaccctgacctatggcgttcagtgctttagccgctatccggatcatatgaaacagcatgatttctttaaaagcgcgatgccggaaggctatgtgcaggaacgtaccatttttttcaaagatgatggcaactataaaacccgtgcggaagttaaatttgaaggcgataccctggtgaaccgcattgaactgaaaggtattgattttaaagaagatggcaacattctgggtcataaactggaatataattacaacagccataatgtgtatattatggccgataaacagaaaaatggcatcaaagtgaactttaaaatccgtcacaacattgaagatggtagcgtgcagctggcggatcattatcagcagaataccccgattggtgatggcccggtgctgctgccggataatcattatctgagcacccagagcgcgctgagcaaagatccgaatgaaaaacgtgatcatatggtgctgctggaatttgttaccgccgcgggcattaccctgggtatggatgaactgtataaa

SEQ ID NO: 404 - DNA, 4464 bp, Artificial Sequence
  SYNTHETIC
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatctgctgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacatgcgccagcgcctgctcctgcacccgctccagctcctgctcctgcgccagctcctgcacctgcgatggttagcaaaggtgaagaactgtttaccggcgttgtgccgattctggtggaactggatggtgatgtgaatggccataaatttagcgttagcggcgaaggcgaaggtgatgcgacctatggtaaactgaccctgaaatttatttgcaccaccggtaaactgccggttccgtggccgaccctggtgaccaccctgacctatggcgttcagtgctttagccgctatccggatcatatgaaacagcatgatttctttaaaagcgcgatgccggaaggctatgtgcaggaacgtaccatttttttcaaagatgatggcaactataaaacccgtgcggaagttaaatttgaaggcgataccctggtgaaccgcattgaactgaaaggtattgattttaaagaagatggcaacattctgggtcataaactggaatataattacaacagccataatgtgtatattatggccgataaacagaaaaatggcatcaaagtgaactttaaaatccgtcacaacattgaagatggtagcgtgcagctggcggatcattatcagcagaataccccgattggtgatggcccggtgctgctgccggataatcattatctgagcacccagagcgcgctgagcaaagatccgaatgaaaaacgtgatcatatggtgctgctggaatttgttaccgccgcgggcattaccctgggtatggatgaactgtataaa

SEQ ID NO: 405 - DNA, 4470 bp, Artificial Sequence
  SYNTHETIC
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatctgctgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacatgcgccagcgcctgctcctgcacccgctccagctcctgccccagctccagcgcccgctcctgcacctgcgatggttagcaaaggtgaagaactgtttaccggcgttgtgccgattctggtggaactggatggtgatgtgaatggccataaatttagcgttagcggcgaaggcgaaggtgatgcgacctatggtaaactgaccctgaaatttatttgcaccaccggtaaactgccggttccgtggccgaccctggtgaccaccctgacctatggcgttcagtgctttagccgctatccggatcatatgaaacagcatgatttctttaaaagcgcgatgccggaaggctatgtgcaggaacgtaccatttttttcaaagatgatggcaactataaaacccgtgcggaagttaaatttgaaggcgataccctggtgaaccgcattgaactgaaaggtattgattttaaagaagatggcaacattctgggtcataaactggaatataattacaacagccataatgtgtatattatggccgataaacagaaaaatggcatcaaagtgaactttaaaatccgtcacaacattgaagatggtagcgtgcagctggcggatcattatcagcagaataccccgattggtgatggcccggtgctgctgccggataatcattatctgagcacccagagcgcgctgagcaaagatccgaatgaaaaacgtgatcatatggtgctgctggaatttgttaccgccgcgggcattaccctgggtatggatgaactgtataaa

SEQ ID NO: 406 - DNA, 4476 bp, Artificial Sequence
  SYNTHETIC
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatctgctgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacatgcgccagcgcctgctcctgcacccgctccagctcctgccccagctccagcgcccgctcctgctcctgcacctgcgatggttagcaaaggtgaagaactgtttaccggcgttgtgccgattctggtggaactggatggtgatgtgaatggccataaatttagcgttagcggcgaaggcgaaggtgatgcgacctatggtaaactgaccctgaaatttatttgcaccaccggtaaactgccggttccgtggccgaccctggtgaccaccctgacctatggcgttcagtgctttagccgctatccggatcatatgaaacagcatgatttctttaaaagcgcgatgccggaaggctatgtgcaggaacgtaccatttttttcaaagatgatggcaactataaaacccgtgcggaagttaaatttgaaggcgataccctggtgaaccgcattgaactgaaaggtattgattttaaagaagatggcaacattctgggtcataaactggaatataattacaacagccataatgtgtatattatggccgataaacagaaaaatggcatcaaagtgaactttaaaatccgtcacaacattgaagatggtagcgtgcagctggcggatcattatcagcagaataccccgattggtgatggcccggtgctgctgccggataatcattatctgagcacccagagcgcgctgagcaaagatccgaatgaaaaacgtgatcatatggtgctgctggaatttgttaccgccgcgggcattaccctgggtatggatgaactgtataaa

SEQ ID NO: 407 - DNA, 4482 bp, Artificial Sequence
  SYNTHETIC
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatctgctgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacatgcgccagcgcctgctcctgcacccgctccagctcctgccccagctccagcgcccgctcctgcgccagctcctgcacctgcgatggttagcaaaggtgaagaactgtttaccggcgttgtgccgattctggtggaactggatggtgatgtgaatggccataaatttagcgttagcggcgaaggcgaaggtgatgcgacctatggtaaactgaccctgaaatttatttgcaccaccggtaaactgccggttccgtggccgaccctggtgaccaccctgacctatggcgttcagtgctttagccgctatccggatcatatgaaacagcatgatttctttaaaagcgcgatgccggaaggctatgtgcaggaacgtaccatttttttcaaagatgatggcaactataaaacccgtgcggaagttaaatttgaaggcgataccctggtgaaccgcattgaactgaaaggtattgattttaaagaagatggcaacattctgggtcataaactggaatataattacaacagccataatgtgtatattatggccgataaacagaaaaatggcatcaaagtgaactttaaaatccgtcacaacattgaagatggtagcgtgcagctggcggatcattatcagcagaataccccgattggtgatggcccggtgctgctgccggataatcattatctgagcacccagagcgcgctgagcaaagatccgaatgaaaaacgtgatcatatggtgctgctggaatttgttaccgccgcgggcattaccctgggtatggatgaactgtataaa

SEQ ID NO: 408 - DNA, 4488 bp, Artificial Sequence
  SYNTHETIC
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatctgctgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacatgcgccagcgcctgctcctgcacccgctccagctcctgccccagctccagcgcccgctcctgcgccagctcctgcacctgctccagcgatggttagcaaaggtgaagaactgtttaccggcgttgtgccgattctggtggaactggatggtgatgtgaatggccataaatttagcgttagcggcgaaggcgaaggtgatgcgacctatggtaaactgaccctgaaatttatttgcaccaccggtaaactgccggttccgtggccgaccctggtgaccaccctgacctatggcgttcagtgctttagccgctatccggatcatatgaaacagcatgatttctttaaaagcgcgatgccggaaggctatgtgcaggaacgtaccatttttttcaaagatgatggcaactataaaacccgtgcggaagttaaatttgaaggcgataccctggtgaaccgcattgaactgaaaggtattgattttaaagaagatggcaacattctgggtcataaactggaatataattacaacagccataatgtgtatattatggccgataaacagaaaaatggcatcaaagtgaactttaaaatccgtcacaacattgaagatggtagcgtgcagctggcggatcattatcagcagaataccccgattggtgatggcccggtgctgctgccggataatcattatctgagcacccagagcgcgctgagcaaagatccgaatgaaaaacgtgatcatatggtgctgctggaatttgttaccgccgcgggcattaccctgggtatggatgaactgtataaa

SEQ ID NO: 409 - DNA, 4392 bp, Artificial Sequence
  SYNTHETIC
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatctgctgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacatatggtgagcaaaggtgaagaggataatatggccatcatcaaagaattcatgcgcttcaaagttcatatggaaggtagcgttaatggccacgaatttgaaattgaaggtgaaggcgaaggtcgtccgtatgaaggcacccagaccgcaaaactgaaagttaccaaaggtggtccgctgccgtttgcatgggatattctgagtccgcagtttatgtatggtagcaaagcctatgttaaacatccggcagatatcccggattatctgaaactgagctttccggaaggttttaaatgggaacgtgtgatgaattttgaagatggtggtgttgttaccgttacacaggatagcagcctgcaggatggtgaatttatctataaagttaaactgcgtggcacgaattttccgagtgatggtccggttatgcagaaaaaaaccatgggttgggaagcaagcagcgaacgtatgtatccggaagatggcgcactgaaaggtgaaattaaacagcgtctgaagctgaaagatggcggtcattatgatgcagaagttaaaaccacctacaaagccaaaaaaccggttcagctgcctggtgcatataacgttaacattaaactggatatcaccagccacaacgaggattataccattgttgaacagtatgaacgtgcagaaggtcgccatagtaccggtggtatggatgaactgtataaa

SEQ ID NO: 410 - DNA, 4428 bp, Artificial Sequence
  SYNTHETIC
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatctgctgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacatggtagcgcaggtagtgcagcaggtagcggtgaatttatggtgagcaaaggtgaagaggataatatggccatcatcaaagaattcatgcgcttcaaagttcatatggaaggtagcgttaatggccacgaatttgaaattgaaggtgaaggcgaaggtcgtccgtatgaaggcacccagaccgcaaaactgaaagttaccaaaggtggtccgctgccgtttgcatgggatattctgagtccgcagtttatgtatggtagcaaagcctatgttaaacatccggcagatatcccggattatctgaaactgagctttccggaaggttttaaatgggaacgtgtgatgaattttgaagatggtggtgttgttaccgttacacaggatagcagcctgcaggatggtgaatttatctataaagttaaactgcgtggcacgaattttccgagtgatggtccggttatgcagaaaaaaaccatgggttgggaagcaagcagcgaacgtatgtatccggaagatggcgcactgaaaggtgaaattaaacagcgtctgaagctgaaagatggcggtcattatgatgcagaagttaaaaccacctacaaagccaaaaaaccggttcagctgcctggtgcatataacgttaacattaaactggatatcaccagccacaacgaggattataccattgttgaacagtatgaacgtgcagaaggtcgccatagtaccggtggtatggatgaactgtataaa

SEQ ID NO: 411 - DNA, 4452 bp, Artificial Sequence
  SYNTHETIC
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatctgctgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacatggaggcggaggatcaggcggtggcggaagtggtggaggtgggtcgggaggtggtggtagcatggtgagcaaaggtgaagaggataatatggccatcatcaaagaattcatgcgcttcaaagttcatatggaaggtagcgttaatggccacgaatttgaaattgaaggtgaaggcgaaggtcgtccgtatgaaggcacccagaccgcaaaactgaaagttaccaaaggtggtccgctgccgtttgcatgggatattctgagtccgcagtttatgtatggtagcaaagcctatgttaaacatccggcagatatcccggattatctgaaactgagctttccggaaggttttaaatgggaacgtgtgatgaattttgaagatggtggtgttgttaccgttacacaggatagcagcctgcaggatggtgaatttatctataaagttaaactgcgtggcacgaattttccgagtgatggtccggttatgcagaaaaaaaccatgggttgggaagcaagcagcgaacgtatgtatccggaagatggcgcactgaaaggtgaaattaaacagcgtctgaagctgaaagatggcggtcattatgatgcagaagttaaaaccacctacaaagccaaaaaaccggttcagctgcctggtgcatataacgttaacattaaactggatatcaccagccacaacgaggattataccattgttgaacagtatgaacgtgcagaaggtcgccatagtaccggtggtatggatgaactgtataaa

SEQ ID NO: 412 - DNA, 4437 bp, Artificial Sequence
  SYNTHETIC
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatctgctgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacatggaggcggagggtcggaagcggcagcaaaaggaggcggaggaagtatggtgagcaaaggtgaagaggataatatggccatcatcaaagaattcatgcgcttcaaagttcatatggaaggtagcgttaatggccacgaatttgaaattgaaggtgaaggcgaaggtcgtccgtatgaaggcacccagaccgcaaaactgaaagttaccaaaggtggtccgctgccgtttgcatgggatattctgagtccgcagtttatgtatggtagcaaagcctatgttaaacatccggcagatatcccggattatctgaaactgagctttccggaaggttttaaatgggaacgtgtgatgaattttgaagatggtggtgttgttaccgttacacaggatagcagcctgcaggatggtgaatttatctataaagttaaactgcgtggcacgaattttccgagtgatggtccggttatgcagaaaaaaaccatgggttgggaagcaagcagcgaacgtatgtatccggaagatggcgcactgaaaggtgaaattaaacagcgtctgaagctgaaagatggcggtcattatgatgcagaagttaaaaccacctacaaagccaaaaaaccggttcagctgcctggtgcatataacgttaacattaaactggatatcaccagccacaacgaggattataccattgttgaacagtatgaacgtgcagaaggtcgccatagtaccggtggtatggatgaactgtataaa

SEQ ID NO: 413 - DNA, 4458 bp, Artificial Sequence
  SYNTHETIC
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatctgctgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacatgctgaggccgcagcaaaagaggctgccgctaaggaggctgctgcaaaagaagcagcagcgaaagctatggtgagcaaaggtgaagaggataatatggccatcatcaaagaattcatgcgcttcaaagttcatatggaaggtagcgttaatggccacgaatttgaaattgaaggtgaaggcgaaggtcgtccgtatgaaggcacccagaccgcaaaactgaaagttaccaaaggtggtccgctgccgtttgcatgggatattctgagtccgcagtttatgtatggtagcaaagcctatgttaaacatccggcagatatcccggattatctgaaactgagctttccggaaggttttaaatgggaacgtgtgatgaattttgaagatggtggtgttgttaccgttacacaggatagcagcctgcaggatggtgaatttatctataaagttaaactgcgtggcacgaattttccgagtgatggtccggttatgcagaaaaaaaccatgggttgggaagcaagcagcgaacgtatgtatccggaagatggcgcactgaaaggtgaaattaaacagcgtctgaagctgaaagatggcggtcattatgatgcagaagttaaaaccacctacaaagccaaaaaaccggttcagctgcctggtgcatataacgttaacattaaactggatatcaccagccacaacgaggattataccattgttgaacagtatgaacgtgcagaaggtcgccatagtaccggtggtatggatgaactgtataaa

SEQ ID NO: 414 - DNA, 4530 bp, Artificial Sequence
  SYNTHETIC
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatctgctgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacatgccgaagcagcagccaaagaagctgccgcaaaggaggcggcagctaaagaagcggccgctaaggcattggaagcggaggcggctgccaaggaggctgcggcgaaagaagctgcggccaaagaagcggctgcaaaagcgatggtgagcaaaggtgaagaggataatatggccatcatcaaagaattcatgcgcttcaaagttcatatggaaggtagcgttaatggccacgaatttgaaattgaaggtgaaggcgaaggtcgtccgtatgaaggcacccagaccgcaaaactgaaagttaccaaaggtggtccgctgccgtttgcatgggatattctgagtccgcagtttatgtatggtagcaaagcctatgttaaacatccggcagatatcccggattatctgaaactgagctttccggaaggttttaaatgggaacgtgtgatgaattttgaagatggtggtgttgttaccgttacacaggatagcagcctgcaggatggtgaatttatctataaagttaaactgcgtggcacgaattttccgagtgatggtccggttatgcagaaaaaaaccatgggttgggaagcaagcagcgaacgtatgtatccggaagatggcgcactgaaaggtgaaattaaacagcgtctgaagctgaaagatggcggtcattatgatgcagaagttaaaaccacctacaaagccaaaaaaccggttcagctgcctggtgcatataacgttaacattaaactggatatcaccagccacaacgaggattataccattgttgaacagtatgaacgtgcagaaggtcgccatagtaccggtggtatggatgaactgtataaa

SEQ ID NO: 415 - DNA, 4542 bp, Artificial Sequence
  SYNTHETIC
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatctgctgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacatttagaggctgaggctgctgccaaggaggctgctgcgaaggaagctgcagctaaagaggcagcggccaaagcacttgaggccgaagccgccgcgaaagaagccgctgctaaggaggcagccgccaaagaagcggcagctaaagcattagaaatggtgagcaaaggtgaagaggataatatggccatcatcaaagaattcatgcgcttcaaagttcatatggaaggtagcgttaatggccacgaatttgaaattgaaggtgaaggcgaaggtcgtccgtatgaaggcacccagaccgcaaaactgaaagttaccaaaggtggtccgctgccgtttgcatgggatattctgagtccgcagtttatgtatggtagcaaagcctatgttaaacatccggcagatatcccggattatctgaaactgagctttccggaaggttttaaatgggaacgtgtgatgaattttgaagatggtggtgttgttaccgttacacaggatagcagcctgcaggatggtgaatttatctataaagttaaactgcgtggcacgaattttccgagtgatggtccggttatgcagaaaaaaaccatgggttgggaagcaagcagcgaacgtatgtatccggaagatggcgcactgaaaggtgaaattaaacagcgtctgaagctgaaagatggcggtcattatgatgcagaagttaaaaccacctacaaagccaaaaaaccggttcagctgcctggtgcatataacgttaacattaaactggatatcaccagccacaacgaggattataccattgttgaacagtatgaacgtgcagaaggtcgccatagtaccggtggtatggatgaactgtataaa

SEQ ID NO: 416 - DNA, 4401 bp, Artificial Sequence
  SYNTHETIC
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatctgctgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacatgcacctgcgatggtgagcaaaggtgaagaggataatatggccatcatcaaagaattcatgcgcttcaaagttcatatggaaggtagcgttaatggccacgaatttgaaattgaaggtgaaggcgaaggtcgtccgtatgaaggcacccagaccgcaaaactgaaagttaccaaaggtggtccgctgccgtttgcatgggatattctgagtccgcagtttatgtatggtagcaaagcctatgttaaacatccggcagatatcccggattatctgaaactgagctttccggaaggttttaaatgggaacgtgtgatgaattttgaagatggtggtgttgttaccgttacacaggatagcagcctgcaggatggtgaatttatctataaagttaaactgcgtggcacgaattttccgagtgatggtccggttatgcagaaaaaaaccatgggttgggaagcaagcagcgaacgtatgtatccggaagatggcgcactgaaaggtgaaattaaacagcgtctgaagctgaaagatggcggtcattatgatgcagaagttaaaaccacctacaaagccaaaaaaccggttcagctgcctggtgcatataacgttaacattaaactggatatcaccagccacaacgaggattataccattgttgaacagtatgaacgtgcagaaggtcgccatagtaccggtggtatggatgaactgtataaa

SEQ ID NO: 417 - DNA, 4407 bp, Artificial Sequence
  SYNTHETIC
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatctgctgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacatgctcctgcacctgcgatggtgagcaaaggtgaagaggataatatggccatcatcaaagaattcatgcgcttcaaagttcatatggaaggtagcgttaatggccacgaatttgaaattgaaggtgaaggcgaaggtcgtccgtatgaaggcacccagaccgcaaaactgaaagttaccaaaggtggtccgctgccgtttgcatgggatattctgagtccgcagtttatgtatggtagcaaagcctatgttaaacatccggcagatatcccggattatctgaaactgagctttccggaaggttttaaatgggaacgtgtgatgaattttgaagatggtggtgttgttaccgttacacaggatagcagcctgcaggatggtgaatttatctataaagttaaactgcgtggcacgaattttccgagtgatggtccggttatgcagaaaaaaaccatgggttgggaagcaagcagcgaacgtatgtatccggaagatggcgcactgaaaggtgaaattaaacagcgtctgaagctgaaagatggcggtcattatgatgcagaagttaaaaccacctacaaagccaaaaaaccggttcagctgcctggtgcatataacgttaacattaaactggatatcaccagccacaacgaggattataccattgttgaacagtatgaacgtgcagaaggtcgccatagtaccggtggtatggatgaactgtataaa

SEQ ID NO: 418 - DNA, 4413 bp, Artificial Sequence
  SYNTHETIC
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatctgctgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacatgcgccagctcctgcacctgcgatggtgagcaaaggtgaagaggataatatggccatcatcaaagaattcatgcgcttcaaagttcatatggaaggtagcgttaatggccacgaatttgaaattgaaggtgaaggcgaaggtcgtccgtatgaaggcacccagaccgcaaaactgaaagttaccaaaggtggtccgctgccgtttgcatgggatattctgagtccgcagtttatgtatggtagcaaagcctatgttaaacatccggcagatatcccggattatctgaaactgagctttccggaaggttttaaatgggaacgtgtgatgaattttgaagatggtggtgttgttaccgttacacaggatagcagcctgcaggatggtgaatttatctataaagttaaactgcgtggcacgaattttccgagtgatggtccggttatgcagaaaaaaaccatgggttgggaagcaagcagcgaacgtatgtatccggaagatggcgcactgaaaggtgaaattaaacagcgtctgaagctgaaagatggcggtcattatgatgcagaagttaaaaccacctacaaagccaaaaaaccggttcagctgcctggtgcatataacgttaacattaaactggatatcaccagccacaacgaggattataccattgttgaacagtatgaacgtgcagaaggtcgccatagtaccggtggtatggatgaactgtataaa

SEQ ID NO: 419 - DNA, 4419 bp, Artificial Sequence
  SYNTHETIC
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatctgctgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacatgctcctgcgccagctcctgcacctgcgatggtgagcaaaggtgaagaggataatatggccatcatcaaagaattcatgcgcttcaaagttcatatggaaggtagcgttaatggccacgaatttgaaattgaaggtgaaggcgaaggtcgtccgtatgaaggcacccagaccgcaaaactgaaagttaccaaaggtggtccgctgccgtttgcatgggatattctgagtccgcagtttatgtatggtagcaaagcctatgttaaacatccggcagatatcccggattatctgaaactgagctttccggaaggttttaaatgggaacgtgtgatgaattttgaagatggtggtgttgttaccgttacacaggatagcagcctgcaggatggtgaatttatctataaagttaaactgcgtggcacgaattttccgagtgatggtccggttatgcagaaaaaaaccatgggttgggaagcaagcagcgaacgtatgtatccggaagatggcgcactgaaaggtgaaattaaacagcgtctgaagctgaaagatggcggtcattatgatgcagaagttaaaaccacctacaaagccaaaaaaccggttcagctgcctggtgcatataacgttaacattaaactggatatcaccagccacaacgaggattataccattgttgaacagtatgaacgtgcagaaggtcgccatagtaccggtggtatggatgaactgtataaa

SEQ ID NO: 420 - DNA, 4425 bp, Artificial Sequence
  SYNTHETIC
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatctgctgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacatgcgcccgctcctgcgccagctcctgcacctgcgatggtgagcaaaggtgaagaggataatatggccatcatcaaagaattcatgcgcttcaaagttcatatggaaggtagcgttaatggccacgaatttgaaattgaaggtgaaggcgaaggtcgtccgtatgaaggcacccagaccgcaaaactgaaagttaccaaaggtggtccgctgccgtttgcatgggatattctgagtccgcagtttatgtatggtagcaaagcctatgttaaacatccggcagatatcccggattatctgaaactgagctttccggaaggttttaaatgggaacgtgtgatgaattttgaagatggtggtgttgttaccgttacacaggatagcagcctgcaggatggtgaatttatctataaagttaaactgcgtggcacgaattttccgagtgatggtccggttatgcagaaaaaaaccatgggttgggaagcaagcagcgaacgtatgtatccggaagatggcgcactgaaaggtgaaattaaacagcgtctgaagctgaaagatggcggtcattatgatgcagaagttaaaaccacctacaaagccaaaaaaccggttcagctgcctggtgcatataacgttaacattaaactggatatcaccagccacaacgaggattataccattgttgaacagtatgaacgtgcagaaggtcgccatagtaccggtggtatggatgaactgtataaa

SEQ ID NO: 421 - DNA, 4431 bp, Artificial Sequence
  SYNTHETIC
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatctgctgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacatgcgccagcgcctgctcctgcacccgctccagcacctgcgatggtgagcaaaggtgaagaggataatatggccatcatcaaagaattcatgcgcttcaaagttcatatggaaggtagcgttaatggccacgaatttgaaattgaaggtgaaggcgaaggtcgtccgtatgaaggcacccagaccgcaaaactgaaagttaccaaaggtggtccgctgccgtttgcatgggatattctgagtccgcagtttatgtatggtagcaaagcctatgttaaacatccggcagatatcccggattatctgaaactgagctttccggaaggttttaaatgggaacgtgtgatgaattttgaagatggtggtgttgttaccgttacacaggatagcagcctgcaggatggtgaatttatctataaagttaaactgcgtggcacgaattttccgagtgatggtccggttatgcagaaaaaaaccatgggttgggaagcaagcagcgaacgtatgtatccggaagatggcgcactgaaaggtgaaattaaacagcgtctgaagctgaaagatggcggtcattatgatgcagaagttaaaaccacctacaaagccaaaaaaccggttcagctgcctggtgcatataacgttaacattaaactggatatcaccagccacaacgaggattataccattgttgaacagtatgaacgtgcagaaggtcgccatagtaccggtggtatggatgaactgtataaa

SEQ ID NO: 422 - DNA, 4437 bp, Artificial Sequence
  SYNTHETIC
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatctgctgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacatgcgccagcgcctgctcctgcacccgctccagctcctgccccagcgatggtgagcaaaggtgaagaggataatatggccatcatcaaagaattcatgcgcttcaaagttcatatggaaggtagcgttaatggccacgaatttgaaattgaaggtgaaggcgaaggtcgtccgtatgaaggcacccagaccgcaaaactgaaagttaccaaaggtggtccgctgccgtttgcatgggatattctgagtccgcagtttatgtatggtagcaaagcctatgttaaacatccggcagatatcccggattatctgaaactgagctttccggaaggttttaaatgggaacgtgtgatgaattttgaagatggtggtgttgttaccgttacacaggatagcagcctgcaggatggtgaatttatctataaagttaaactgcgtggcacgaattttccgagtgatggtccggttatgcagaaaaaaaccatgggttgggaagcaagcagcgaacgtatgtatccggaagatggcgcactgaaaggtgaaattaaacagcgtctgaagctgaaagatggcggtcattatgatgcagaagttaaaaccacctacaaagccaaaaaaccggttcagctgcctggtgcatataacgttaacattaaactggatatcaccagccacaacgaggattataccattgttgaacagtatgaacgtgcagaaggtcgccatagtaccggtggtatggatgaactgtataaa

SEQ ID NO: 423 - DNA, 4443 bp, Artificial Sequence
  SYNTHETIC
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatctgctgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacatgcgccagcgcctgctcctgcacccgctccagcgccagctcctgcacctgcgatggtgagcaaaggtgaagaggataatatggccatcatcaaagaattcatgcgcttcaaagttcatatggaaggtagcgttaatggccacgaatttgaaattgaaggtgaaggcgaaggtcgtccgtatgaaggcacccagaccgcaaaactgaaagttaccaaaggtggtccgctgccgtttgcatgggatattctgagtccgcagtttatgtatggtagcaaagcctatgttaaacatccggcagatatcccggattatctgaaactgagctttccggaaggttttaaatgggaacgtgtgatgaattttgaagatggtggtgttgttaccgttacacaggatagcagcctgcaggatggtgaatttatctataaagttaaactgcgtggcacgaattttccgagtgatggtccggttatgcagaaaaaaaccatgggttgggaagcaagcagcgaacgtatgtatccggaagatggcgcactgaaaggtgaaattaaacagcgtctgaagctgaaagatggcggtcattatgatgcagaagttaaaaccacctacaaagccaaaaaaccggttcagctgcctggtgcatataacgttaacattaaactggatatcaccagccacaacgaggattataccattgttgaacagtatgaacgtgcagaaggtcgccatagtaccggtggtatggatgaactgtataaa

SEQ ID NO: 424 - DNA, 4449 bp, Artificial Sequence
  SYNTHETIC
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatctgctgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacatgcgccagcgcctgctcctgcacccgctccagctcctgcgccagctcctgcacctgcgatggtgagcaaaggtgaagaggataatatggccatcatcaaagaattcatgcgcttcaaagttcatatggaaggtagcgttaatggccacgaatttgaaattgaaggtgaaggcgaaggtcgtccgtatgaaggcacccagaccgcaaaactgaaagttaccaaaggtggtccgctgccgtttgcatgggatattctgagtccgcagtttatgtatggtagcaaagcctatgttaaacatccggcagatatcccggattatctgaaactgagctttccggaaggttttaaatgggaacgtgtgatgaattttgaagatggtggtgttgttaccgttacacaggatagcagcctgcaggatggtgaatttatctataaagttaaactgcgtggcacgaattttccgagtgatggtccggttatgcagaaaaaaaccatgggttgggaagcaagcagcgaacgtatgtatccggaagatggcgcactgaaaggtgaaattaaacagcgtctgaagctgaaagatggcggtcattatgatgcagaagttaaaaccacctacaaagccaaaaaaccggttcagctgcctggtgcatataacgttaacattaaactggatatcaccagccacaacgaggattataccattgttgaacagtatgaacgtgcagaaggtcgccatagtaccggtggtatggatgaactgtataaa

SEQ ID NO: 425 - DNA, 4455 bp, Artificial Sequence
  SYNTHETIC
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatctgctgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacatgcgccagcgcctgctcctgcacccgctccagctcctgctcctgcgccagctcctgcacctgcgatggtgagcaaaggtgaagaggataatatggccatcatcaaagaattcatgcgcttcaaagttcatatggaaggtagcgttaatggccacgaatttgaaattgaaggtgaaggcgaaggtcgtccgtatgaaggcacccagaccgcaaaactgaaagttaccaaaggtggtccgctgccgtttgcatgggatattctgagtccgcagtttatgtatggtagcaaagcctatgttaaacatccggcagatatcccggattatctgaaactgagctttccggaaggttttaaatgggaacgtgtgatgaattttgaagatggtggtgttgttaccgttacacaggatagcagcctgcaggatggtgaatttatctataaagttaaactgcgtggcacgaattttccgagtgatggtccggttatgcagaaaaaaaccatgggttgggaagcaagcagcgaacgtatgtatccggaagatggcgcactgaaaggtgaaattaaacagcgtctgaagctgaaagatggcggtcattatgatgcagaagttaaaaccacctacaaagccaaaaaaccggttcagctgcctggtgcatataacgttaacattaaactggatatcaccagccacaacgaggattataccattgttgaacagtatgaacgtgcagaaggtcgccatagtaccggtggtatggatgaactgtataaa

SEQ ID NO: 426 - DNA, 4461 bp, Artificial Sequence
  SYNTHETIC
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatctgctgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacatgcgccagcgcctgctcctgcacccgctccagctcctgccccagctccagcgcccgctcctgcacctgcgatggtgagcaaaggtgaagaggataatatggccatcatcaaagaattcatgcgcttcaaagttcatatggaaggtagcgttaatggccacgaatttgaaattgaaggtgaaggcgaaggtcgtccgtatgaaggcacccagaccgcaaaactgaaagttaccaaaggtggtccgctgccgtttgcatgggatattctgagtccgcagtttatgtatggtagcaaagcctatgttaaacatccggcagatatcccggattatctgaaactgagctttccggaaggttttaaatgggaacgtgtgatgaattttgaagatggtggtgttgttaccgttacacaggatagcagcctgcaggatggtgaatttatctataaagttaaactgcgtggcacgaattttccgagtgatggtccggttatgcagaaaaaaaccatgggttgggaagcaagcagcgaacgtatgtatccggaagatggcgcactgaaaggtgaaattaaacagcgtctgaagctgaaagatggcggtcattatgatgcagaagttaaaaccacctacaaagccaaaaaaccggttcagctgcctggtgcatataacgttaacattaaactggatatcaccagccacaacgaggattataccattgttgaacagtatgaacgtgcagaaggtcgccatagtaccggtggtatggatgaactgtataaa

SEQ ID NO: 427 - DNA, 4467 bp, Artificial Sequence
  SYNTHETIC
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatctgctgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacatgcgccagcgcctgctcctgcacccgctccagctcctgccccagctccagcgcccgctcctgctcctgcacctgcgatggtgagcaaaggtgaagaggataatatggccatcatcaaagaattcatgcgcttcaaagttcatatggaaggtagcgttaatggccacgaatttgaaattgaaggtgaaggcgaaggtcgtccgtatgaaggcacccagaccgcaaaactgaaagttaccaaaggtggtccgctgccgtttgcatgggatattctgagtccgcagtttatgtatggtagcaaagcctatgttaaacatccggcagatatcccggattatctgaaactgagctttccggaaggttttaaatgggaacgtgtgatgaattttgaagatggtggtgttgttaccgttacacaggatagcagcctgcaggatggtgaatttatctataaagttaaactgcgtggcacgaattttccgagtgatggtccggttatgcagaaaaaaaccatgggttgggaagcaagcagcgaacgtatgtatccggaagatggcgcactgaaaggtgaaattaaacagcgtctgaagctgaaagatggcggtcattatgatgcagaagttaaaaccacctacaaagccaaaaaaccggttcagctgcctggtgcatataacgttaacattaaactggatatcaccagccacaacgaggattataccattgttgaacagtatgaacgtgcagaaggtcgccatagtaccggtggtatggatgaactgtataaa

SEQ ID NO: 428 - DNA, 4473 bp, Artificial Sequence
  SYNTHETIC
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatctgctgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacatgcgccagcgcctgctcctgcacccgctccagctcctgccccagctccagcgcccgctcctgcgccagctcctgcacctgcgatggtgagcaaaggtgaagaggataatatggccatcatcaaagaattcatgcgcttcaaagttcatatggaaggtagcgttaatggccacgaatttgaaattgaaggtgaaggcgaaggtcgtccgtatgaaggcacccagaccgcaaaactgaaagttaccaaaggtggtccgctgccgtttgcatgggatattctgagtccgcagtttatgtatggtagcaaagcctatgttaaacatccggcagatatcccggattatctgaaactgagctttccggaaggttttaaatgggaacgtgtgatgaattttgaagatggtggtgttgttaccgttacacaggatagcagcctgcaggatggtgaatttatctataaagttaaactgcgtggcacgaattttccgagtgatggtccggttatgcagaaaaaaaccatgggttgggaagcaagcagcgaacgtatgtatccggaagatggcgcactgaaaggtgaaattaaacagcgtctgaagctgaaagatggcggtcattatgatgcagaagttaaaaccacctacaaagccaaaaaaccggttcagctgcctggtgcatataacgttaacattaaactggatatcaccagccacaacgaggattataccattgttgaacagtatgaacgtgcagaaggtcgccatagtaccggtggtatggatgaactgtataaa

SEQ ID NO: 429 - DNA, 4479 bp, Artificial Sequence
  SYNTHETIC
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatctgctgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacatgcgccagcgcctgctcctgcacccgctccagctcctgccccagctccagcgcccgctcctgcgccagctcctgcacctgctccagcgatggtgagcaaaggtgaagaggataatatggccatcatcaaagaattcatgcgcttcaaagttcatatggaaggtagcgttaatggccacgaatttgaaattgaaggtgaaggcgaaggtcgtccgtatgaaggcacccagaccgcaaaactgaaagttaccaaaggtggtccgctgccgtttgcatgggatattctgagtccgcagtttatgtatggtagcaaagcctatgttaaacatccggcagatatcccggattatctgaaactgagctttccggaaggttttaaatgggaacgtgtgatgaattttgaagatggtggtgttgttaccgttacacaggatagcagcctgcaggatggtgaatttatctataaagttaaactgcgtggcacgaattttccgagtgatggtccggttatgcagaaaaaaaccatgggttgggaagcaagcagcgaacgtatgtatccggaagatggcgcactgaaaggtgaaattaaacagcgtctgaagctgaaagatggcggtcattatgatgcagaagttaaaaccacctacaaagccaaaaaaccggttcagctgcctggtgcatataacgttaacattaaactggatatcaccagccacaacgaggattataccattgttgaacagtatgaacgtgcagaaggtcgccatagtaccggtggtatggatgaactgtataaa

What is claimed is:

1. A chimeric protein consisting of a guided endonuclease protein, a rigid linker, and a first protein,
   wherein the chimeric protein is the protein of SEQ ID NO:49.

2. A method of enriching cells having a chimeric protein, comprising:

a) incubating the chimeric protein according to claim 1 with a guide RNA to form a RNP complex;
b) contacting the RNP complex to a plurality of target cells to produce recipient cells having the RNP complex; and
c) sorting the recipient cells based on a fluorescence signal.

* * * * *